United States Patent 7,250,289 (METHODS OF GENETIC ANALYSIS OF MOUSE) - sequence listing, part 25

SEQ ID NO: 963189 - DNA, 25 bp, Mus musculus
tttaagctgctgacaaataggaatg

SEQ ID NO: 963190 - DNA, 25 bp, Mus musculus
tttaagctgctgatttcccatgaga

SEQ ID NO: 963191 - DNA, 25 bp, Mus musculus
tttaagctgctgtcaaataggaatg

SEQ ID NO: 963192 - DNA, 25 bp, Mus musculus
tttaagctgctgttttcccatgaga

SEQ ID NO: 963193 - DNA, 25 bp, Mus musculus
tttaagcttcagacctaagggtcag

SEQ ID NO: 963194 - DNA, 25 bp, Mus musculus
tttaagcttcagtcctaagggtcag

SEQ ID NO: 963195 - DNA, 25 bp, Mus musculus
tttaaggaggctcttggtactgtgt

SEQ ID NO: 963196 - DNA, 25 bp, Mus musculus
tttaaggaggctgttggtactgtgt

SEQ ID NO: 963197 - DNA, 25 bp, Mus musculus
tttaaggatgtacgcactgctcaaa

SEQ ID NO: 963198 - DNA, 25 bp, Mus musculus
tttaaggatgtaggcactgctcaaa

SEQ ID NO: 963199 - DNA, 25 bp, Mus musculus
tttaaggcacagatcctcgagtggg

SEQ ID NO: 963200 - DNA, 25 bp, Mus musculus
tttaaggcacagttcctcgagtggg

SEQ ID NO: 963201 - DNA, 25 bp, Mus musculus
tttaaggcatgcattctccatttgg

SEQ ID NO: 963202 - DNA, 25 bp, Mus musculus
tttaaggcatgctttctccatttgg

SEQ ID NO: 963203 - DNA, 25 bp, Mus musculus
tttaaggccccaaggtgatgaacct

SEQ ID NO: 963204 - DNA, 25 bp, Mus musculus
tttaaggccccatggtgatgaacct

SEQ ID NO: 963205 - DNA, 25 bp, Mus musculus
tttaaggcccttatcatcccaggca

SEQ ID NO: 963206 - DNA, 25 bp, Mus musculus
tttaaggcccttttcatcccaggca

SEQ ID NO: 963207 - DNA, 25 bp, Mus musculus
tttaaggctagacaacagaggtgct

SEQ ID NO: 963208 - DNA, 25 bp, Mus musculus
tttaaggctagagaacagaggtgct

SEQ ID NO: 963209 - DNA, 25 bp, Mus musculus
tttaaggctgacattgccccattaa

SEQ ID NO: 963210 - DNA, 25 bp, Mus musculus
tttaaggctgactttgccccattaa

SEQ ID NO: 963211 - DNA, 25 bp, Mus musculus
tttaaggctttccttaccatatatc

SEQ ID NO: 963212 - DNA, 25 bp, Mus musculus
tttaaggctttcgttaccatatatc

SEQ ID NO: 963213 - DNA, 25 bp, Mus musculus
tttaaggctttgaaccacatagttt

SEQ ID NO: 963214 - DNA, 25 bp, Mus musculus
tttaaggctttgtaccacatagttt

SEQ ID NO: 963215 - DNA, 25 bp, Mus musculus
tttaaggcttttcccagtctccgaa

SEQ ID NO: 963216 - DNA, 25 bp, Mus musculus
tttaaggcttttgccagtctccgaa

SEQ ID NO: 963217 - DNA, 25 bp, Mus musculus
tttaagggaccaactcctcgacctg

SEQ ID NO: 963218 - DNA, 25 bp, Mus musculus
tttaagggaccacatttgttcaatg

SEQ ID NO: 963219 - DNA, 25 bp, Mus musculus
tttaagggaccagatttgttcaatg

SEQ ID NO: 963220 - DNA, 25 bp, Mus musculus
tttaagggaccatctcctcgacctg

SEQ ID NO: 963221 - DNA, 25 bp, Mus musculus
tttaagggcacaattcccatcagtt

SEQ ID NO: 963222 - DNA, 25 bp, Mus musculus
tttaagggcacatttcccatcagtt

SEQ ID NO: 963223 - DNA, 25 bp, Mus musculus
tttaaggtgcctcctgttcctctac

SEQ ID NO: 963224 - DNA, 25 bp, Mus musculus
tttaaggtgcctgctgttcctctac

SEQ ID NO: 963225 - DNA, 25 bp, Mus musculus
tttaaggtgtataccatcgaaagag

SEQ ID NO: 963226 - DNA, 25 bp, Mus musculus
tttaaggtgtattccatcgaaagag

SEQ ID NO: 963227 - DNA, 25 bp, Mus musculus
tttaaggttactctctgggaattct

SEQ ID NO: 963228 - DNA, 25 bp, Mus musculus
tttaaggttactgtctgggaattct

SEQ ID NO: 963229 - DNA, 25 bp, Mus musculus
tttaagtatactactccacagggaa

SEQ ID NO: 963230 - DNA, 25 bp, Mus musculus
tttaagtatacttctccacagggaa

SEQ ID NO: 963231 - DNA, 25 bp, Mus musculus
tttaagtatctaatgcctcaagcaa

SEQ ID NO: 963232 - DNA, 25 bp, Mus musculus
tttaagtatctattgcctcaagcaa

SEQ ID NO: 963233 - DNA, 25 bp, Mus musculus
tttaagtatggcagtatatttctgc

SEQ ID NO: 963234 - DNA, 25 bp, Mus musculus
tttaagtatggctgtatatttctgc

SEQ ID NO: 963235 - DNA, 25 bp, Mus musculus
tttaagtcaccgatccctttgatgc

SEQ ID NO: 963236 - DNA, 25 bp, Mus musculus
tttaagtcaccgttccctttgatgc

SEQ ID NO: 963237 - DNA, 25 bp, Mus musculus
tttaagtcataccatcacctagctc

SEQ ID NO: 963238 - DNA, 25 bp, Mus musculus
tttaagtcatacgatcacctagctc

SEQ ID NO: 963239 - DNA, 25 bp, Mus musculus
tttaagtccatgaatcagcaccagt

SEQ ID NO: 963240 - DNA, 25 bp, Mus musculus
tttaagtccatgtatcagcaccagt

SEQ ID NO: 963241 - DNA, 25 bp, Mus musculus
tttaagtcctagaatgtcacccgtg

SEQ ID NO: 963242 - DNA, 25 bp, Mus musculus
tttaagtcctagtatgtcacccgtg

SEQ ID NO: 963243 - DNA, 25 bp, Mus musculus
tttaagtcggcacgtgtcacgctac

SEQ ID NO: 963244 - DNA, 25 bp, Mus musculus
tttaagtcggcaggtgtcacgctac

SEQ ID NO: 963245 - DNA, 25 bp, Mus musculus
tttaagtctcgacttcattattttc

SEQ ID NO: 963246 - DNA, 25 bp, Mus musculus
tttaagtctcgagttcattattttc

SEQ ID NO: 963247 - DNA, 25 bp, Mus musculus
tttaagtcttagctcggccgcgatg

SEQ ID NO: 963248 - DNA, 25 bp, Mus musculus
tttaagtcttaggtcggccgcgatg

SEQ ID NO: 963249 - DNA, 25 bp, Mus musculus
tttaagtgacacctcatttgtctgg

SEQ ID NO: 963250 - DNA, 25 bp, Mus musculus
tttaagtgacacgtcatttgtctgg

SEQ ID NO: 963251 - DNA, 25 bp, Mus musculus
tttaagtgagtcaattaggcattct

SEQ ID NO: 963252 - DNA, 25 bp, Mus musculus
tttaagtgagtctattaggcattct

SEQ ID NO: 963253 - DNA, 25 bp, Mus musculus
tttaagtgcctcctactggcagcaa

SEQ ID NO: 963254 - DNA, 25 bp, Mus musculus
tttaagtgcctcgtactggcagcaa

SEQ ID NO: 963255 - DNA, 25 bp, Mus musculus
tttaagttcaacactggctactcat

SEQ ID NO: 963256 - DNA, 25 bp, Mus musculus
tttaagttcaactctggctactcat

SEQ ID NO: 963257 - DNA, 25 bp, Mus musculus
tttaagttccctagttctcactcca

SEQ ID NO: 963258 - DNA, 25 bp, Mus musculus
tttaagttcccttgttctcactcca

SEQ ID NO: 963259 - DNA, 25 bp, Mus musculus
tttaagttctccattcagcaccttt

SEQ ID NO: 963260 - DNA, 25 bp, Mus musculus
tttaagttctcctttcagcaccttt

SEQ ID NO: 963261 - DNA, 25 bp, Mus musculus
tttaagttgcacaggcatgcctcca

SEQ ID NO: 963262 - DNA, 25 bp, Mus musculus
tttaagttgcactggcatgcctcca

SEQ ID NO: 963263 - DNA, 25 bp, Mus musculus
tttaagtttaaaccctcgctcagct

SEQ ID NO: 963264 - DNA, 25 bp, Mus musculus
tttaagtttaaagcctcgctcagct

SEQ ID NO: 963265 - DNA, 25 bp, Mus musculus
tttaagtttctaaatgtaggtcatt

SEQ ID NO: 963266 - DNA, 25 bp, Mus musculus
tttaagtttctatatgtaggtcatt

SEQ ID NO: 963267 - DNA, 25 bp, Mus musculus
tttaagtttgttcatgccatgcctg

SEQ ID NO: 963268 - DNA, 25 bp, Mus musculus
tttaagtttgttgatgccatgcctg

SEQ ID NO: 963269 - DNA, 25 bp, Mus musculus
tttaataaatctacctcccaactca

SEQ ID NO: 963270 - DNA, 25 bp, Mus musculus
tttaataaatcttcctcccaactca

SEQ ID NO: 963271 - DNA, 25 bp, Mus musculus
tttaataacccaaagtccacatact

SEQ ID NO: 963272 - DNA, 25 bp, Mus musculus
tttaataacccatagtccacatact

SEQ ID NO: 963273 - DNA, 25 bp, Mus musculus
tttaataagaacaactcggacaggt

SEQ ID NO: 963274 - DNA, 25 bp, Mus musculus
tttaataagaactactcggacaggt

SEQ ID NO: 963275 - DNA, 25 bp, Mus musculus
tttaatacaggccaagctacccctg

SEQ ID NO: 963276 - DNA, 25 bp, Mus musculus
tttaatacaggcgaagctacccctg

SEQ ID NO: 963277 - DNA, 25 bp, Mus musculus
tttaatacatttctttaccactcgt

SEQ ID NO: 963278 - DNA, 25 bp, Mus musculus
tttaatacatttgtttaccactcgt

SEQ ID NO: 963279 - DNA, 25 bp, Mus musculus
tttaatactgtcatttgaggcttat

SEQ ID NO: 963280 - DNA, 25 bp, Mus musculus
tttaatactgtcttttgaggcttat

SEQ ID NO: 963281 - DNA, 25 bp, Mus musculus
tttaatacttcaccgcttgtcactt

SEQ ID NO: 963282 - DNA, 25 bp, Mus musculus
tttaatacttcagcgcttgtcactt

SEQ ID NO: 963283 - DNA, 25 bp, Mus musculus
tttaatagaaagcatggcaccaatg

SEQ ID NO: 963284 - DNA, 25 bp, Mus musculus
tttaatagaaaggatggcaccaatg

SEQ ID NO: 963285 - DNA, 25 bp, Mus musculus
tttaataggcctcatgcagcccctt

SEQ ID NO: 963286 - DNA, 25 bp, Mus musculus
tttaataggcctgatgcagcccctt

SEQ ID NO: 963287 - DNA, 25 bp, Mus musculus
tttaatagtactctccccatcaaga

SEQ ID NO: 963288 - DNA, 25 bp, Mus musculus
tttaatagtactgtccccatcaaga

SEQ ID NO: 963289 - DNA, 25 bp, Mus musculus
tttaatagttgaagtgagggctgga

SEQ ID NO: 963290 - DNA, 25 bp, Mus musculus
tttaatagttgatgtgagggctgga

SEQ ID NO: 963291 - DNA, 25 bp, Mus musculus
tttaatataaaactgtccatttggg

SEQ ID NO: 963292 - DNA, 25 bp, Mus musculus
tttaatataaaagtgtccatttggg

SEQ ID NO: 963293 - DNA, 25 bp, Mus musculus
tttaatatatagattggttctggcc

SEQ ID NO: 963294 - DNA, 25 bp, Mus musculus
tttaatatatagtttggttctggcc

SEQ ID NO: 963295 - DNA, 25 bp, Mus musculus
tttaatatcaccaccttgggctcct

SEQ ID NO: 963296 - DNA, 25 bp, Mus musculus
tttaatatcacctccttgggctcct

SEQ ID NO: 963297 - DNA, 25 bp, Mus musculus
tttaatatcgacagagccccaactt

SEQ ID NO: 963298 - DNA, 25 bp, Mus musculus
tttaatatcgactgagccccaactt

SEQ ID NO: 963299 - DNA, 25 bp, Mus musculus
tttaatatgcacagtttcctcaaaa

SEQ ID NO: 963300 - DNA, 25 bp, Mus musculus
tttaatatgcactgtttcctcaaaa

SEQ ID NO: 963301 - DNA, 25 bp, Mus musculus
tttaatatgcctcctgtagtgcccc

SEQ ID NO: 963302 - DNA, 25 bp, Mus musculus
tttaatatgcctgctgtagtgcccc

SEQ ID NO: 963303 - DNA, 25 bp, Mus musculus
tttaatattaaacttggtgcttctc

SEQ ID NO: 963304 - DNA, 25 bp, Mus musculus
tttaatattaaagttggtgcttctc

SEQ ID NO: 963305 - DNA, 25 bp, Mus musculus
tttaatattcaccaagatgtttagg

SEQ ID NO: 963306 - DNA, 25 bp, Mus musculus
tttaatattcacgaagatgtttagg

SEQ ID NO: 963307 - DNA, 25 bp, Mus musculus
tttaatcaaaagatcggtcacctgg

SEQ ID NO: 963308 - DNA, 25 bp, Mus musculus
tttaatcaaaagttcggtcacctgg

SEQ ID NO: 963309 - DNA, 25 bp, Mus musculus
tttaatcaaccgctttcctgatgcg

SEQ ID NO: 963310 - DNA, 25 bp, Mus musculus
tttaatcaaccggtttcctgatgcg

SEQ ID NO: 963311 - DNA, 25 bp, Mus musculus
tttaatcacaccaatacctaccata

SEQ ID NO: 963312 - DNA, 25 bp, Mus musculus
tttaatcacacctatacctaccata

SEQ ID NO: 963313 - DNA, 25 bp, Mus musculus
tttaatcactatagcccttgggaag

SEQ ID NO: 963314 - DNA, 25 bp, Mus musculus
tttaatcactattgcccttgggaag

SEQ ID NO: 963315 - DNA, 25 bp, Mus musculus
tttaatcagcacatattcagcatat

SEQ ID NO: 963316 - DNA, 25 bp, Mus musculus
tttaatcagcacttattcagcatat

SEQ ID NO: 963317 - DNA, 25 bp, Mus musculus
tttaatcatatactttcccttccct

SEQ ID NO: 963318 - DNA, 25 bp, Mus musculus
tttaatcatatagtttcccttccct

SEQ ID NO: 963319 - DNA, 25 bp, Mus musculus
tttaatcccaatcgttagaaggcag

SEQ ID NO: 963320 - DNA, 25 bp, Mus musculus
tttaatcccaatggttagaaggcag

SEQ ID NO: 963321 - DNA, 25 bp, Mus musculus
tttaatcccagacccacattgtaat

SEQ ID NO: 963322 - DNA, 25 bp, Mus musculus
tttaatcccagagccacattgtaat

SEQ ID NO: 963323 - DNA, 25 bp, Mus musculus
tttaatcccagtataatctgagttc

SEQ ID NO: 963324 - DNA, 25 bp, Mus musculus
tttaatcccagtccataagaggcta

SEQ ID NO: 963325 - DNA, 25 bp, Mus musculus
tttaatcccagtgcataagaggcta

SEQ ID NO: 963326 - DNA, 25 bp, Mus musculus
tttaatcccagtttaatctgagttc

SEQ ID NO: 963327 - DNA, 25 bp, Mus musculus
tttaatccccaaatgtgcccttgtc

SEQ ID NO: 963328 - DNA, 25 bp, Mus musculus
tttaatccccaattgtgcccttgtc

SEQ ID NO: 963329 - DNA, 25 bp, Mus musculus
tttaatcccgtgcaagactcctgtt

SEQ ID NO: 963330 - DNA, 25 bp, Mus musculus
tttaatcccgtggaagactcctgtt

SEQ ID NO: 963331 - DNA, 25 bp, Mus musculus
tttaatccctgcacatgcaaatctc

SEQ ID NO: 963332 - DNA, 25 bp, Mus musculus
tttaatccctgctcatgcaaatctc

SEQ ID NO: 963333 - DNA, 25 bp, Mus musculus
tttaatccgcaccttacagactggt

SEQ ID NO: 963334 - DNA, 25 bp, Mus musculus
tttaatccgcacgttacagactggt

SEQ ID NO: 963335 - DNA, 25 bp, Mus musculus
tttaatcctcacaactggccactga

SEQ ID NO: 963336 - DNA, 25 bp, Mus musculus
tttaatcctcaccatcaaaaacaag

SEQ ID NO: 963337 - DNA, 25 bp, Mus musculus
tttaatcctcacgatcaaaaacaag

SEQ ID NO: 963338 - DNA, 25 bp, Mus musculus
tttaatcctcactactggccactga

SEQ ID NO: 963339 - DNA, 25 bp, Mus musculus
tttaatcctcctactgttcgcaggg

SEQ ID NO: 963340 - DNA, 25 bp, Mus musculus
tttaatcctccttctgttcgcaggg

SEQ ID NO: 963341 - DNA, 25 bp, Mus musculus
tttaatcctcgtcctttgtgaagca

SEQ ID NO: 963342 - DNA, 25 bp, Mus musculus
tttaatcctcgtgctttgtgaagca

SEQ ID NO: 963343 - DNA, 25 bp, Mus musculus
tttaatcgcctgcactggaggtaaa

SEQ ID NO: 963344 - DNA, 25 bp, Mus musculus
tttaatcgcctggactggaggtaaa

SEQ ID NO: 963345 - DNA, 25 bp, Mus musculus
tttaatcgccttcggcaggaacaga

SEQ ID NO: 963346 - DNA, 25 bp, Mus musculus
tttaatcgccttgggcaggaacaga

SEQ ID NO: 963347 - DNA, 25 bp, Mus musculus
tttaatcgtaacattcctgcatgtg

SEQ ID NO: 963348 - DNA, 25 bp, Mus musculus
tttaatcgtaactttcctgcatgtg

SEQ ID NO: 963349 - DNA, 25 bp, Mus musculus
tttaatctattgaatggatcctcat

SEQ ID NO: 963350 - DNA, 25 bp, Mus musculus
tttaatctattgtatggatcctcat

SEQ ID NO: 963351 - DNA, 25 bp, Mus musculus
tttaatctcagccttggtacgtgcc

SEQ ID NO: 963352 - DNA, 25 bp, Mus musculus
tttaatctcagcgttggtacgtgcc

SEQ ID NO: 963353 - DNA, 25 bp, Mus musculus
tttaatctcagtatggaccttctcc

SEQ ID NO: 963354 - DNA, 25 bp, Mus musculus
tttaatctcagtttggaccttctcc

SEQ ID NO: 963355 - DNA, 25 bp, Mus musculus
tttaatctccatacagaagcacaaa

SEQ ID NO: 963356 - DNA, 25 bp, Mus musculus
tttaatctccattcagaagcacaaa

SEQ ID NO: 963357 - DNA, 25 bp, Mus musculus
tttaatctctgcagttcatctcatt

SEQ ID NO: 963358 - DNA, 25 bp, Mus musculus
tttaatctctgctgttcatctcatt

SEQ ID NO: 963359 - DNA, 25 bp, Mus musculus
tttaatcttcaacggctctcattaa

SEQ ID NO: 963360 - DNA, 25 bp, Mus musculus
tttaatcttcaagggctctcattaa

SEQ ID NO: 963361 - DNA, 25 bp, Mus musculus
tttaatcttcctagttgtgtgcctc

SEQ ID NO: 963362 - DNA, 25 bp, Mus musculus
tttaatcttccttgttgtgtgcctc

SEQ ID NO: 963363 - DNA, 25 bp, Mus musculus
tttaatctttacatatgcaccccac

SEQ ID NO: 963364 - DNA, 25 bp, Mus musculus
tttaatctttacatccctatctagg

SEQ ID NO: 963365 - DNA, 25 bp, Mus musculus
tttaatctttacttatgcaccccac

SEQ ID NO: 963366 - DNA, 25 bp, Mus musculus
tttaatctttacttccctatctagg

SEQ ID NO: 963367 - DNA, 25 bp, Mus musculus
tttaatgacccaaactgagacctat

SEQ ID NO: 963368 - DNA, 25 bp, Mus musculus
tttaatgacccatactgagacctat

SEQ ID NO: 963369 - DNA, 25 bp, Mus musculus
tttaatgaccgaaggctgccaggca

SEQ ID NO: 963370 - DNA, 25 bp, Mus musculus
tttaatgaccgatggctgccaggca

SEQ ID NO: 963371 - DNA, 25 bp, Mus musculus
tttaatgagcccagttgggagtgag

SEQ ID NO: 963372 - DNA, 25 bp, Mus musculus
tttaatgagccctgttgggagtgag

SEQ ID NO: 963373 - DNA, 25 bp, Mus musculus
tttaatgaggctcggctcttgtccc

SEQ ID NO: 963374 - DNA, 25 bp, Mus musculus
tttaatgaggctgggctcttgtccc

SEQ ID NO: 963375 - DNA, 25 bp, Mus musculus
tttaatgcaacacttggtagacaga

SEQ ID NO: 963376 - DNA, 25 bp, Mus musculus
tttaatgcaacagttggtagacaga

SEQ ID NO: 963377 - DNA, 25 bp, Mus musculus
tttaatgcacaacttgcttgtacag

SEQ ID NO: 963378 - DNA, 25 bp, Mus musculus
tttaatgcacaagttgcttgtacag

SEQ ID NO: 963379 - DNA, 25 bp, Mus musculus
tttaatgcatgcatctgctatcccc

SEQ ID NO: 963380 - DNA, 25 bp, Mus musculus
tttaatgcatgcttctgctatcccc

SEQ ID NO: 963381 - DNA, 25 bp, Mus musculus
tttaatgccctgagagccagttctc

SEQ ID NO: 963382 - DNA, 25 bp, Mus musculus
tttaatgccctgtgagccagttctc

SEQ ID NO: 963383 - DNA, 25 bp, Mus musculus
tttaatgcccttacaagggtttctg

SEQ ID NO: 963384 - DNA, 25 bp, Mus musculus
tttaatgccctttcaagggtttctg

SEQ ID NO: 963385 - DNA, 25 bp, Mus musculus
tttaatgcctataccagaggctctg

SEQ ID NO: 963386 - DNA, 25 bp, Mus musculus
tttaatgcctattccagaggctctg

SEQ ID NO: 963387 - DNA, 25 bp, Mus musculus
tttaatgcgccactttgatgatgcc

SEQ ID NO: 963388 - DNA, 25 bp, Mus musculus
tttaatgcgccagtttgatgatgcc

SEQ ID NO: 963389 - DNA, 25 bp, Mus musculus
tttaatgctgcaacctcaggtacag

SEQ ID NO: 963390 - DNA, 25 bp, Mus musculus
tttaatgctgcatcctcaggtacag

SEQ ID NO: 963391 - DNA, 25 bp, Mus musculus
tttaatgcttgcacttcattgtttg

SEQ ID NO: 963392 - DNA, 25 bp, Mus musculus
tttaatgcttgctcttcattgtttg

SEQ ID NO: 963393 - DNA, 25 bp, Mus musculus
tttaatgctttgattgtgtctggaa

SEQ ID NO: 963394 - DNA, 25 bp, Mus musculus
tttaatgctttgtttgtgtctggaa

SEQ ID NO: 963395 - DNA, 25 bp, Mus musculus
tttaatggaaccaccctacacgtgc

SEQ ID NO: 963396 - DNA, 25 bp, Mus musculus
tttaatggaacctccctacacgtgc

SEQ ID NO: 963397 - DNA, 25 bp, Mus musculus
tttaatggactgcacttttcccatg

SEQ ID NO: 963398 - DNA, 25 bp, Mus musculus
tttaatggactggacttttcccatg

SEQ ID NO: 963399 - DNA, 25 bp, Mus musculus
tttaatggagctaaacttgctaaaa

SEQ ID NO: 963400 - DNA, 25 bp, Mus musculus
tttaatggagcttaacttgctaaaa

SEQ ID NO: 963401 - DNA, 25 bp, Mus musculus
tttaatggcaaaaatactgacgtat

SEQ ID NO: 963402 - DNA, 25 bp, Mus musculus
tttaatggcaaatatactgacgtat

SEQ ID NO: 963403 - DNA, 25 bp, Mus musculus
tttaatggcaacagtgttcccggca

SEQ ID NO: 963404 - DNA, 25 bp, Mus musculus
tttaatggcaactgtgttcccggca

SEQ ID NO: 963405 - DNA, 25 bp, Mus musculus
tttaatggccagattaaaacctatg

SEQ ID NO: 963406 - DNA, 25 bp, Mus musculus
tttaatggccagtttaaaacctatg

SEQ ID NO: 963407 - DNA, 25 bp, Mus musculus
tttaatggccataagacagcgtctc

SEQ ID NO: 963408 - DNA, 25 bp, Mus musculus
tttaatggccattagacagcgtctc

SEQ ID NO: 963409 - DNA, 25 bp, Mus musculus
tttaatggcctgaggctctggctaa

SEQ ID NO: 963410 - DNA, 25 bp, Mus musculus
tttaatggcctgagggttctgatcc

SEQ ID NO: 963411 - DNA, 25 bp, Mus musculus
tttaatggcctgtggctctggctaa

SEQ ID NO: 963412 - DNA, 25 bp, Mus musculus
tttaatggcctgtgggttctgatcc

SEQ ID NO: 963413 - DNA, 25 bp, Mus musculus
tttaatggctaaccatgtcttccca

SEQ ID NO: 963414 - DNA, 25 bp, Mus musculus
tttaatggctaactccctaccacca

SEQ ID NO: 963415 - DNA, 25 bp, Mus musculus
tttaatggctaagcatgtcttccca

SEQ ID NO: 963416 - DNA, 25 bp, Mus musculus
tttaatggctaagtccctaccacca

SEQ ID NO: 963417 - DNA, 25 bp, Mus musculus
tttaatggctcacccgatcactcct

SEQ ID NO: 963418 - DNA, 25 bp, Mus musculus
tttaatggctcagccgatcactcct

SEQ ID NO: 963419 - DNA, 25 bp, Mus musculus
tttaatggtggtcgcaattataccc

SEQ ID NO: 963420 - DNA, 25 bp, Mus musculus
tttaatggtggtggcaattataccc

SEQ ID NO: 963421 - DNA, 25 bp, Mus musculus
tttaatgtaacgaccggtgtgcttc

SEQ ID NO: 963422 - DNA, 25 bp, Mus musculus
tttaatgtaacgtccggtgtgcttc

SEQ ID NO: 963423 - DNA, 25 bp, Mus musculus
tttaatgtaagcacttgctctcccg

SEQ ID NO: 963424 - DNA, 25 bp, Mus musculus
tttaatgtaagctcttgctctcccg

SEQ ID NO: 963425 - DNA, 25 bp, Mus musculus
tttaatgtatcacctagaaactggg

SEQ ID NO: 963426 - DNA, 25 bp, Mus musculus
tttaatgtatcagctagaaactggg

SEQ ID NO: 963427 - DNA, 25 bp, Mus musculus
tttaatgtcccacatttgtacatag

SEQ ID NO: 963428 - DNA, 25 bp, Mus musculus
tttaatgtcccagatttgtacatag

SEQ ID NO: 963429 - DNA, 25 bp, Mus musculus
tttaatgtgcaaaatcccctacttt

SEQ ID NO: 963430 - DNA, 25 bp, Mus musculus
tttaatgtgcaatatcccctacttt

SEQ ID NO: 963431 - DNA, 25 bp, Mus musculus
tttaatgtgcctacctaaccaggag

SEQ ID NO: 963432 - DNA, 25 bp, Mus musculus
tttaatgtgccttcctaaccaggag

SEQ ID NO: 963433 - DNA, 25 bp, Mus musculus
tttaatgttcatagcctgggcaccc

SEQ ID NO: 963434 - DNA, 25 bp, Mus musculus
tttaatgttcattgcctgggcaccc

SEQ ID NO: 963435 - DNA, 25 bp, Mus musculus
tttaatgtttggaggatttccttca

SEQ ID NO: 963436 - DNA, 25 bp, Mus musculus
tttaatgtttggtggatttccttca

SEQ ID NO: 963437 - DNA, 25 bp, Mus musculus
tttaattaccagcaccatcttcttc

SEQ ID NO: 963438 - DNA, 25 bp, Mus musculus
tttaattaccaggaccatcttcttc

SEQ ID NO: 963439 - DNA, 25 bp, Mus musculus
tttaattacctcaatgatcatgctt

SEQ ID NO: 963440 - DNA, 25 bp, Mus musculus
tttaattacctctatgatcatgctt

SEQ ID NO: 963441 - DNA, 25 bp, Mus musculus
tttaattactccactagctctgcta

SEQ ID NO: 963442 - DNA, 25 bp, Mus musculus
tttaattactcctctagctctgcta

SEQ ID NO: 963443 - DNA, 25 bp, Mus musculus
tttaattactggagcctccttatga

SEQ ID NO: 963444 - DNA, 25 bp, Mus musculus
tttaattactggtgcctccttatga

SEQ ID NO: 963445 - DNA, 25 bp, Mus musculus
tttaattagaatccccagagagaaa

SEQ ID NO: 963446 - DNA, 25 bp, Mus musculus
tttaattagaatgcccagagagaaa

SEQ ID NO: 963447 - DNA, 25 bp, Mus musculus
tttaattataagactcaaccttgag

SEQ ID NO: 963448 - DNA, 25 bp, Mus musculus
tttaattataagtctcaaccttgag

SEQ ID NO: 963449 - DNA, 25 bp, Mus musculus
tttaattataccattccagtgagcc

SEQ ID NO: 963450 - DNA, 25 bp, Mus musculus
tttaattatacctttccagtgagcc

SEQ ID NO: 963451 - DNA, 25 bp, Mus musculus
tttaattatcaactctcaccccaga

SEQ ID NO: 963452 - DNA, 25 bp, Mus musculus
tttaattatcaagtctcaccccaga

SEQ ID NO: 963453 - DNA, 25 bp, Mus musculus
tttaattcagtcatcccaagcacgc

SEQ ID NO: 963454 - DNA, 25 bp, Mus musculus
tttaattcagtcttcccaagcacgc

SEQ ID NO: 963455 - DNA, 25 bp, Mus musculus
tttaattccctactctcttagcagg

SEQ ID NO: 963456 - DNA, 25 bp, Mus musculus
tttaattccctagtctcttagcagg

SEQ ID NO: 963457 - DNA, 25 bp, Mus musculus
tttaattcctgtaagcactcttctg

SEQ ID NO: 963458 - DNA, 25 bp, Mus musculus
tttaattcctgttagcactcttctg

SEQ ID NO: 963459 - DNA, 25 bp, Mus musculus
tttaattctcaaatctgtccatgga

SEQ ID NO: 963460 - DNA, 25 bp, Mus musculus
tttaattctcaattctgtccatgga

SEQ ID NO: 963461 - DNA, 25 bp, Mus musculus
tttaattctgctaaggtgccttaca

SEQ ID NO: 963462 - DNA, 25 bp, Mus musculus
tttaattctgcttaggtgccttaca

SEQ ID NO: 963463 - DNA, 25 bp, Mus musculus
tttaattgatctaacaggccggtgt

SEQ ID NO: 963464 - DNA, 25 bp, Mus musculus
tttaattgatcttacaggccggtgt

SEQ ID NO: 963465 - DNA, 25 bp, Mus musculus
tttaattggcggatgggccattcct

SEQ ID NO: 963466 - DNA, 25 bp, Mus musculus
tttaattggcggttgggccattcct

SEQ ID NO: 963467 - DNA, 25 bp, Mus musculus
tttaattgtgaaaactggctctcca

SEQ ID NO: 963468 - DNA, 25 bp, Mus musculus
tttaattgtgaatactggctctcca

SEQ ID NO: 963469 - DNA, 25 bp, Mus musculus
tttaatttagcccacctctttctgt

SEQ ID NO: 963470 - DNA, 25 bp, Mus musculus
tttaatttagccgacctctttctgt

SEQ ID NO: 963471 - DNA, 25 bp, Mus musculus
tttaatttcaccatcatcggaccgg

SEQ ID NO: 963472 - DNA, 25 bp, Mus musculus
tttaatttcaccttcatcggaccgg

SEQ ID NO: 963473 - DNA, 25 bp, Mus musculus
tttaatttcaggacccctagatggg

SEQ ID NO: 963474 - DNA, 25 bp, Mus musculus
tttaatttcaggtcccctagatggg

SEQ ID NO: 963475 - DNA, 25 bp, Mus musculus
tttaatttccgtcttggtcacatcc

SEQ ID NO: 963476 - DNA, 25 bp, Mus musculus
tttaatttccgtgttggtcacatcc

SEQ ID NO: 963477 - DNA, 25 bp, Mus musculus
tttaatttctgtacaccgtgcatcc

SEQ ID NO: 963478 - DNA, 25 bp, Mus musculus
tttaatttctgttcaccgtgcatcc

SEQ ID NO: 963479 - DNA, 25 bp, Mus musculus
tttaatttgccaaactgctcctcca

SEQ ID NO: 963480 - DNA, 25 bp, Mus musculus
tttaatttgccatactgctcctcca

SEQ ID NO: 963481 - DNA, 25 bp, Mus musculus
tttaatttggacctcctgacttctg

SEQ ID NO: 963482 - DNA, 25 bp, Mus musculus
tttaatttggacgtcctgacttctg

SEQ ID NO: 963483 - DNA, 25 bp, Mus musculus
tttaatttgggccttaccctggctg

SEQ ID NO: 963484 - DNA, 25 bp, Mus musculus
tttaatttgggcgttaccctggctg

SEQ ID NO: 963485 - DNA, 25 bp, Mus musculus
tttacaaaacccaatgagtgcttgc

SEQ ID NO: 963486 - DNA, 25 bp, Mus musculus
tttacaaaaccctatgagtgcttgc

SEQ ID NO: 963487 - DNA, 25 bp, Mus musculus
tttacaaaagcaagctctccctatc

SEQ ID NO: 963488 - DNA, 25 bp, Mus musculus
tttacaaaagcatgctctccctatc

SEQ ID NO: 963489 - DNA, 25 bp, Mus musculus
tttacaaacaagacacacaccataa

SEQ ID NO: 963490 - DNA, 25 bp, Mus musculus
tttacaaacaagtcacacaccataa

SEQ ID NO: 963491 - DNA, 25 bp, Mus musculus
tttacaaagggcctctcttccacag

SEQ ID NO: 963492 - DNA, 25 bp, Mus musculus
tttacaaagggcgtctcttccacag

SEQ ID NO: 963493 - DNA, 25 bp, Mus musculus
tttacaaagtcccagtcagtccaag

SEQ ID NO: 963494 - DNA, 25 bp, Mus musculus
tttacaaagtccgagtcagtccaag

SEQ ID NO: 963495 - DNA, 25 bp, Mus musculus
tttacaaatctcagtgggccactga

SEQ ID NO: 963496 - DNA, 25 bp, Mus musculus
tttacaaatctctgtgggccactga

SEQ ID NO: 963497 - DNA, 25 bp, Mus musculus
tttacaacaagcctccagaaatcga

SEQ ID NO: 963498 - DNA, 25 bp, Mus musculus
tttacaacaagcgtccagaaatcga

SEQ ID NO: 963499 - DNA, 25 bp, Mus musculus
tttacaacactcctagggcttctct

SEQ ID NO: 963500 - DNA, 25 bp, Mus musculus
tttacaacactcgtagggcttctct

SEQ ID NO: 963501 - DNA, 25 bp, Mus musculus
tttacaaccacaagccacaaaggga

SEQ ID NO: 963502 - DNA, 25 bp, Mus musculus
tttacaaccacatgccacaaaggga

SEQ ID NO: 963503 - DNA, 25 bp, Mus musculus
tttacaaccacccagccgcgccagc

SEQ ID NO: 963504 - DNA, 25 bp, Mus musculus
tttacaaccaccgagccgcgccagc

SEQ ID NO: 963505 - DNA, 25 bp, Mus musculus
tttacaacccctaccaacagtgcag

SEQ ID NO: 963506 - DNA, 25 bp, Mus musculus
tttacaaccccttccaacagtgcag

SEQ ID NO: 963507 - DNA, 25 bp, Mus musculus
tttacaactccaactacattggctc

SEQ ID NO: 963508 - DNA, 25 bp, Mus musculus
tttacaactccatctacattggctc

SEQ ID NO: 963509 - DNA, 25 bp, Mus musculus
tttacaacttctactctccactcaa

SEQ ID NO: 963510 - DNA, 25 bp, Mus musculus
tttacaacttcttctctccactcaa

SEQ ID NO: 963511 - DNA, 25 bp, Mus musculus
tttacaagacttcaggctcttcctt

SEQ ID NO: 963512 - DNA, 25 bp, Mus musculus
tttacaagacttgaggctcttcctt

SEQ ID NO: 963513 - DNA, 25 bp, Mus musculus
tttacaagcagcagcgcaaccctag

SEQ ID NO: 963514 - DNA, 25 bp, Mus musculus
tttacaagcagcctcacaagtgtgg

SEQ ID NO: 963515 - DNA, 25 bp, Mus musculus
tttacaagcagcgtcacaagtgtgg

SEQ ID NO: 963516 - DNA, 25 bp, Mus musculus
tttacaagcagctgcgcaaccctag

SEQ ID NO: 963517 - DNA, 25 bp, Mus musculus
tttacaagggctacagcttcttaaa

SEQ ID NO: 963518 - DNA, 25 bp, Mus musculus
tttacaagggcttcagcttcttaaa

SEQ ID NO: 963519 - DNA, 25 bp, Mus musculus
tttacaagttccactttagccacag

SEQ ID NO: 963520 - DNA, 25 bp, Mus musculus
tttacaagttcctctttagccacag

SEQ ID NO: 963521 - DNA, 25 bp, Mus musculus
tttacaatgcaacttcaggctttgg

SEQ ID NO: 963522 - DNA, 25 bp, Mus musculus
tttacaatgcaagttcaggctttgg

SEQ ID NO: 963523 - DNA, 25 bp, Mus musculus
tttacaatgcttatgagtcactggg

SEQ ID NO: 963524 - DNA, 25 bp, Mus musculus
tttacaatgcttttgagtcactggg

SEQ ID NO: 963525 - DNA, 25 bp, Mus musculus
tttacaatggagagccagggcttcc

SEQ ID NO: 963526 - DNA, 25 bp, Mus musculus
tttacaatggagtgccagggcttcc

SEQ ID NO: 963527 - DNA, 25 bp, Mus musculus
tttacaatggtgcttaagttccagc

SEQ ID NO: 963528 - DNA, 25 bp, Mus musculus
tttacaatggtggttaagttccagc

SEQ ID NO: 963529 - DNA, 25 bp, Mus musculus
tttacaatgtgtattgaggtttaca

SEQ ID NO: 963530 - DNA, 25 bp, Mus musculus
tttacaatgtgttttgaggtttaca

SEQ ID NO: 963531 - DNA, 25 bp, Mus musculus
tttacaattctcactctctggatag

SEQ ID NO: 963532 - DNA, 25 bp, Mus musculus
tttacaattctctctctctggatag

SEQ ID NO: 963533 - DNA, 25 bp, Mus musculus
tttacaattgtcatagtccctgcca

SEQ ID NO: 963534 - DNA, 25 bp, Mus musculus
tttacaattgtcttagtccctgcca

SEQ ID NO: 963535 - DNA, 25 bp, Mus musculus
tttacacaccggcatatttcttgtt

SEQ ID NO: 963536 - DNA, 25 bp, Mus musculus
tttacacaccgggatatttcttgtt

SEQ ID NO: 963537 - DNA, 25 bp, Mus musculus
tttacacacgctcctgacgatgtta

SEQ ID NO: 963538 - DNA, 25 bp, Mus musculus
tttacacacgctgctgacgatgtta

SEQ ID NO: 963539 - DNA, 25 bp, Mus musculus
tttacacactgccacttcagtttgg

SEQ ID NO: 963540 - DNA, 25 bp, Mus musculus
tttacacactgcgacttcagtttgg

SEQ ID NO: 963541 - DNA, 25 bp, Mus musculus
tttacacagctgataggtccctaca

SEQ ID NO: 963542 - DNA, 25 bp, Mus musculus
tttacacagctgttaggtccctaca

SEQ ID NO: 963543 - DNA, 25 bp, Mus musculus
tttacacagtcactgtacatcaagg

SEQ ID NO: 963544 - DNA, 25 bp, Mus musculus
tttacacagtcagtgtacatcaagg

SEQ ID NO: 963545 - DNA, 25 bp, Mus musculus
tttacacagtgactcattcctgcac

SEQ ID NO: 963546 - DNA, 25 bp, Mus musculus
tttacacagtgagtcattcctgcac

SEQ ID NO: 963547 - DNA, 25 bp, Mus musculus
tttacacagtttatagccaccctgc

SEQ ID NO: 963548 - DNA, 25 bp, Mus musculus
tttacacagtttttagccaccctgc

SEQ ID NO: 963549 - DNA, 25 bp, Mus musculus
tttacacatgagagaccaggtttga

SEQ ID NO: 963550 - DNA, 25 bp, Mus musculus
tttacacatgagtgaccaggtttga

SEQ ID NO: 963551 - DNA, 25 bp, Mus musculus
tttacaccacacagctctagagttg

SEQ ID NO: 963552 - DNA, 25 bp, Mus musculus
tttacaccacactgctctagagttg

SEQ ID NO: 963553 - DNA, 25 bp, Mus musculus
tttacaccactgctttgactccaat

SEQ ID NO: 963554 - DNA, 25 bp, Mus musculus
tttacaccactggtttgactccaat

SEQ ID NO: 963555 - DNA, 25 bp, Mus musculus
tttacaccagaactcatccttttgt

SEQ ID NO: 963556 - DNA, 25 bp, Mus musculus
tttacaccagaagtcatccttttgt

SEQ ID NO: 963557 - DNA, 25 bp, Mus musculus
tttacaccagacattctccacagag

SEQ ID NO: 963558 - DNA, 25 bp, Mus musculus
tttacaccagactttctccacagag

SEQ ID NO: 963559 - DNA, 25 bp, Mus musculus
tttacaccagtaattacagccctta

SEQ ID NO: 963560 - DNA, 25 bp, Mus musculus
tttacaccagtatttacagccctta

SEQ ID NO: 963561 - DNA, 25 bp, Mus musculus
tttacaccagtgatgaactcagcta

SEQ ID NO: 963562 - DNA, 25 bp, Mus musculus
tttacaccagtgttgaactcagcta

SEQ ID NO: 963563 - DNA, 25 bp, Mus musculus
tttacaccccgcatgaagagtttga

SEQ ID NO: 963564 - DNA, 25 bp, Mus musculus
tttacaccccgcttgaagagtttga

SEQ ID NO: 963565 - DNA, 25 bp, Mus musculus
tttacaccctttactattgggattg

SEQ ID NO: 963566 - DNA, 25 bp, Mus musculus
tttacacccttttctattgggattg

SEQ ID NO: 963567 - DNA, 25 bp, Mus musculus
tttacaccttaccagctttgatgac

SEQ ID NO: 963568 - DNA, 25 bp, Mus musculus
tttacaccttacgagctttgatgac

SEQ ID NO: 963569 - DNA, 25 bp, Mus musculus
tttacacgtacacacatgcatgcac

SEQ ID NO: 963570 - DNA, 25 bp, Mus musculus
tttacacgtacagacatgcatgcac

SEQ ID NO: 963571 - DNA, 25 bp, Mus musculus
tttacactagcaactgcattatttg

SEQ ID NO: 963572 - DNA, 25 bp, Mus musculus
tttacactagcatctgcattatttg

SEQ ID NO: 963573 - DNA, 25 bp, Mus musculus
tttacactgtgacggtttgggcttt

SEQ ID NO: 963574 - DNA, 25 bp, Mus musculus
tttacactgtgagggtttgggcttt

SEQ ID NO: 963575 - DNA, 25 bp, Mus musculus
tttacactgttaatgcccacatgta

SEQ ID NO: 963576 - DNA, 25 bp, Mus musculus
tttacactgttattgcccacatgta

SEQ ID NO: 963577 - DNA, 25 bp, Mus musculus
tttacactttggagccaggcctgtt

SEQ ID NO: 963578 - DNA, 25 bp, Mus musculus
tttacactttggtgccaggcctgtt

SEQ ID NO: 963579 - DNA, 25 bp, Mus musculus
tttacagaaataacccagagactgg

SEQ ID NO: 963580 - DNA, 25 bp, Mus musculus
tttacagaaatatcccagagactgg

SEQ ID NO: 963581 - DNA, 25 bp, Mus musculus
tttacagaaccacccagagtacagg

SEQ ID NO: 963582 - DNA, 25 bp, Mus musculus
tttacagaaccagccagagtacagg

SEQ ID NO: 963583 - DNA, 25 bp, Mus musculus
tttacagacacgaccatcatccttt

SEQ ID NO: 963584 - DNA, 25 bp, Mus musculus
tttacagacacgtccatcatccttt

SEQ ID NO: 963585 - DNA, 25 bp, Mus musculus
tttacagaccttatgcactttatgc

SEQ ID NO: 963586 - DNA, 25 bp, Mus musculus
tttacagaccttttgcactttatgc

SEQ ID NO: 963587 - DNA, 25 bp, Mus musculus
tttacagacggcaatagaggaccat

SEQ ID NO: 963588 - DNA, 25 bp, Mus musculus
tttacagacggctatagaggaccat

SEQ ID NO: 963589 - DNA, 25 bp, Mus musculus
tttacagacgttacttggaagcttt

SEQ ID NO: 963590 - DNA, 25 bp, Mus musculus
tttacagacgtttcttggaagcttt

SEQ ID NO: 963591 - DNA, 25 bp, Mus musculus
tttacagactgtcctgtggccaggc

SEQ ID NO: 963592 - DNA, 25 bp, Mus musculus
tttacagactgtgctgtggccaggc

SEQ ID NO: 963593 - DNA, 25 bp, Mus musculus
tttacagagaaccagccaccactct

SEQ ID NO: 963594 - DNA, 25 bp, Mus musculus
tttacagagaacgagccaccactct

SEQ ID NO: 963595 - DNA, 25 bp, Mus musculus
tttacagatattctccccctttgat

SEQ ID NO: 963596 - DNA, 25 bp, Mus musculus
tttacagatattgtccccctttgat

SEQ ID NO: 963597 - DNA, 25 bp, Mus musculus
tttacagattccagactcgccgaaa

SEQ ID NO: 963598 - DNA, 25 bp, Mus musculus
tttacagattcctgactcgccgaaa

SEQ ID NO: 963599 - DNA, 25 bp, Mus musculus
tttacagatttgaaccctgctttcc

SEQ ID NO: 963600 - DNA, 25 bp, Mus musculus
tttacagatttgtaccctgctttcc

SEQ ID NO: 963601 - DNA, 25 bp, Mus musculus
tttacagcactaactatccttctct

SEQ ID NO: 963602 - DNA, 25 bp, Mus musculus
tttacagcactatctatccttctct

SEQ ID NO: 963603 - DNA, 25 bp, Mus musculus
tttacagcaggtctccacaaagcct

SEQ ID NO: 963604 - DNA, 25 bp, Mus musculus
tttacagcaggtgtccacaaagcct

SEQ ID NO: 963605 - DNA, 25 bp, Mus musculus
tttacagccacaaggtacgtcctgg

SEQ ID NO: 963606 - DNA, 25 bp, Mus musculus
tttacagccacatggtacgtcctgg

SEQ ID NO: 963607 - DNA, 25 bp, Mus musculus
tttacagcgttcagacatagtttga

SEQ ID NO: 963608 - DNA, 25 bp, Mus musculus
tttacagcgttctgacatagtttga

SEQ ID NO: 963609 - DNA, 25 bp, Mus musculus
tttacagctctgctcacaccgtagc

SEQ ID NO: 963610 - DNA, 25 bp, Mus musculus
tttacagctctggtcacaccgtagc

SEQ ID NO: 963611 - DNA, 25 bp, Mus musculus
tttacagctcttatacattcactaa

SEQ ID NO: 963612 - DNA, 25 bp, Mus musculus
tttacagctcttttacattcactaa

SEQ ID NO: 963613 - DNA, 25 bp, Mus musculus
tttacagctgataccaaacacactc

SEQ ID NO: 963614 - DNA, 25 bp, Mus musculus
tttacagctgattccaaacacactc

SEQ ID NO: 963615 - DNA, 25 bp, Mus musculus
tttacagctgtgactaaactcagaa

SEQ ID NO: 963616 - DNA, 25 bp, Mus musculus
tttacagctgtgtctaaactcagaa

SEQ ID NO: 963617 - DNA, 25 bp, Mus musculus
tttacagcttatccccagcattcct

SEQ ID NO: 963618 - DNA, 25 bp, Mus musculus
tttacagcttatgcccagcattcct

SEQ ID NO: 963619 - DNA, 25 bp, Mus musculus
tttacagcttcaaacccataccttg

SEQ ID NO: 963620 - DNA, 25 bp, Mus musculus
tttacagcttcatacccataccttg

SEQ ID NO: 963621 - DNA, 25 bp, Mus musculus
tttacaggcacccaaccagacgtca

SEQ ID NO: 963622 - DNA, 25 bp, Mus musculus
tttacaggcacccaatcgcacattc

SEQ ID NO: 963623 - DNA, 25 bp, Mus musculus
tttacaggcaccgaaccagacgtca

SEQ ID NO: 963624 - DNA, 25 bp, Mus musculus
tttacaggcaccgaatcgcacattc

SEQ ID NO: 963625 - DNA, 25 bp, Mus musculus
tttacaggctcactctccgagagga

SEQ ID NO: 963626 - DNA, 25 bp, Mus musculus
tttacaggctcagtctccgagagga

SEQ ID NO: 963627 - DNA, 25 bp, Mus musculus
tttacaggcttacgtgaacacacac

SEQ ID NO: 963628 - DNA, 25 bp, Mus musculus
tttacaggcttaggtgaacacacac

SEQ ID NO: 963629 - DNA, 25 bp, Mus musculus
tttacaggtaaaatgccctcccctg

SEQ ID NO: 963630 - DNA, 25 bp, Mus musculus
tttacaggtaaattgccctcccctg

SEQ ID NO: 963631 - DNA, 25 bp, Mus musculus
tttacaggtgcactcaccgaaagag

SEQ ID NO: 963632 - DNA, 25 bp, Mus musculus
tttacaggtgcagtcaccgaaagag

SEQ ID NO: 963633 - DNA, 25 bp, Mus musculus
tttacagtaggcaggtcctgtgcac

SEQ ID NO: 963634 - DNA, 25 bp, Mus musculus
tttacagtaggctggtcctgtgcac

SEQ ID NO: 963635 - DNA, 25 bp, Mus musculus
tttacagtagtgagcttcagcttca

SEQ ID NO: 963636 - DNA, 25 bp, Mus musculus
tttacagtagtgtgcttcagcttca

SEQ ID NO: 963637 - DNA, 25 bp, Mus musculus
tttacagtcaggagcacccaagcca

SEQ ID NO: 963638 - DNA, 25 bp, Mus musculus
tttacagtcaggtgcacccaagcca

SEQ ID NO: 963639 - DNA, 25 bp, Mus musculus
tttacagtccaaacattatcctcct

SEQ ID NO: 963640 - DNA, 25 bp, Mus musculus
tttacagtccaatcattatcctcct

SEQ ID NO: 963641 - DNA, 25 bp, Mus musculus
tttacagtgacacgccacagcgcgt

SEQ ID NO: 963642 - DNA, 25 bp, Mus musculus
tttacagtgacaggccacagcgcgt

SEQ ID NO: 963643 - DNA, 25 bp, Mus musculus
tttacagtgaccaggcggatctcat

SEQ ID NO: 963644 - DNA, 25 bp, Mus musculus
tttacagtgacctggcggatctcat

SEQ ID NO: 963645 - DNA, 25 bp, Mus musculus
tttacagtgtcaacatccacacgct

SEQ ID NO: 963646 - DNA, 25 bp, Mus musculus
tttacagtgtcatcatccacacgct

SEQ ID NO: 963647 - DNA, 25 bp, Mus musculus
tttacagttacacttccaggacgat

SEQ ID NO: 963648 - DNA, 25 bp, Mus musculus
tttacagttacagttccaggacgat

SEQ ID NO: 963649 - DNA, 25 bp, Mus musculus
tttacagttctgacaccagggagta

SEQ ID NO: 963650 - DNA, 25 bp, Mus musculus
tttacagttctgtcaccagggagta

SEQ ID NO: 963651 - DNA, 25 bp, Mus musculus
tttacagttgtcacctgcagttaat

SEQ ID NO: 963652 - DNA, 25 bp, Mus musculus
tttacagttgtctcctgcagttaat

SEQ ID NO: 963653 - DNA, 25 bp, Mus musculus
tttacagtttatcctaggcccaccc

SEQ ID NO: 963654 - DNA, 25 bp, Mus musculus
tttacagtttatgctaggcccaccc

SEQ ID NO: 963655 - DNA, 25 bp, Mus musculus
tttacagtttcccaactgctggcca

SEQ ID NO: 963656 - DNA, 25 bp, Mus musculus
tttacagtttccgaactgctggcca

SEQ ID NO: 963657 - DNA, 25 bp, Mus musculus
tttacagtttgtccgtgtatggaaa

SEQ ID NO: 963658 - DNA, 25 bp, Mus musculus
tttacagtttgtgcgtgtatggaaa

SEQ ID NO: 963659 - DNA, 25 bp, Mus musculus
tttacagttttactacgtatctggc

SEQ ID NO: 963660 - DNA, 25 bp, Mus musculus
tttacagttttagtacgtatctggc

SEQ ID NO: 963661 - DNA, 25 bp, Mus musculus
tttacataactactttccctctgac

SEQ ID NO: 963662 - DNA, 25 bp, Mus musculus
tttacataactagtttccctctgac

SEQ ID NO: 963663 - DNA, 25 bp, Mus musculus
tttacataatctctgctgtctgttc

SEQ ID NO: 963664 - DNA, 25 bp, Mus musculus
tttacataatctgtgctgtctgttc

SEQ ID NO: 963665 - DNA, 25 bp, Mus musculus
tttacataattaatcggcggtattg

SEQ ID NO: 963666 - DNA, 25 bp, Mus musculus
tttacataattattcggcggtattg

SEQ ID NO: 963667 - DNA, 25 bp, Mus musculus
tttacatacaacacggcttcaacct

SEQ ID NO: 963668 - DNA, 25 bp, Mus musculus
tttacatacaactcggcttcaacct

SEQ ID NO: 963669 - DNA, 25 bp, Mus musculus
tttacataccttcaactagcaatac

SEQ ID NO: 963670 - DNA, 25 bp, Mus musculus
tttacataccttgaactagcaatac

SEQ ID NO: 963671 - DNA, 25 bp, Mus musculus
tttacatacgacatgaagggtcatt

SEQ ID NO: 963672 - DNA, 25 bp, Mus musculus
tttacatacgacttgaagggtcatt

SEQ ID NO: 963673 - DNA, 25 bp, Mus musculus
tttacatactttcctggcatctatc

SEQ ID NO: 963674 - DNA, 25 bp, Mus musculus
tttacatactttgctggcatctatc

SEQ ID NO: 963675 - DNA, 25 bp, Mus musculus
tttacatagtagctttccactccga

SEQ ID NO: 963676 - DNA, 25 bp, Mus musculus
tttacatagtaggtttccactccga

SEQ ID NO: 963677 - DNA, 25 bp, Mus musculus
tttacatatatcagccgtggatcca

SEQ ID NO: 963678 - DNA, 25 bp, Mus musculus
tttacatatatctgccgtggatcca

SEQ ID NO: 963679 - DNA, 25 bp, Mus musculus
tttacatatattcccttcctctact

SEQ ID NO: 963680 - DNA, 25 bp, Mus musculus
tttacatatattgccttcctctact

SEQ ID NO: 963681 - DNA, 25 bp, Mus musculus
tttacatattataacctgtggcagg

SEQ ID NO: 963682 - DNA, 25 bp, Mus musculus
tttacatattattacctgtggcagg

SEQ ID NO: 963683 - DNA, 25 bp, Mus musculus
tttacatatttcatcacattggtca

SEQ ID NO: 963684 - DNA, 25 bp, Mus musculus
tttacatatttcttcacattggtca

SEQ ID NO: 963685 - DNA, 25 bp, Mus musculus
tttacatcagaaattgcttttgttt

SEQ ID NO: 963686 - DNA, 25 bp, Mus musculus
tttacatcagaatttgcttttgttt

SEQ ID NO: 963687 - DNA, 25 bp, Mus musculus
tttacatcagtaccacatcttgtgt

SEQ ID NO: 963688 - DNA, 25 bp, Mus musculus
tttacatcagtagcacatcttgtgt

SEQ ID NO: 963689 - DNA, 25 bp, Mus musculus
tttacatccaacatcaacggccgat

SEQ ID NO: 963690 - DNA, 25 bp, Mus musculus
tttacatccaacttcaacggccgat

SEQ ID NO: 963691 - DNA, 25 bp, Mus musculus
tttacatcccagctccaaagtatac

SEQ ID NO: 963692 - DNA, 25 bp, Mus musculus
tttacatcccaggtccaaagtatac

SEQ ID NO: 963693 - DNA, 25 bp, Mus musculus
tttacatccctcagagcttcgagaa

SEQ ID NO: 963694 - DNA, 25 bp, Mus musculus
tttacatccctctgagcttcgagaa

SEQ ID NO: 963695 - DNA, 25 bp, Mus musculus
tttacatcgcatatcgtaactgtag

SEQ ID NO: 963696 - DNA, 25 bp, Mus musculus
tttacatcgcatttcgtaactgtag

SEQ ID NO: 963697 - DNA, 25 bp, Mus musculus
tttacatcggagaccagctgtacca

SEQ ID NO: 963698 - DNA, 25 bp, Mus musculus
tttacatcggagtccagctgtacca

SEQ ID NO: 963699 - DNA, 25 bp, Mus musculus
tttacatctgagagagtgtctgtca

SEQ ID NO: 963700 - DNA, 25 bp, Mus musculus
tttacatctgagtgagtgtctgtca

SEQ ID NO: 963701 - DNA, 25 bp, Mus musculus
tttacatctgcaatcgtcagcacgg

SEQ ID NO: 963702 - DNA, 25 bp, Mus musculus
tttacatctgcattcgtcagcacgg

SEQ ID NO: 963703 - DNA, 25 bp, Mus musculus
tttacatgactcattacagagctgc

SEQ ID NO: 963704 - DNA, 25 bp, Mus musculus
tttacatgactctttacagagctgc

SEQ ID NO: 963705 - DNA, 25 bp, Mus musculus
tttacatgagacacttctggacagg

SEQ ID NO: 963706 - DNA, 25 bp, Mus musculus
tttacatgagactcttctggacagg

SEQ ID NO: 963707 - DNA, 25 bp, Mus musculus
tttacatgcactcaatgtggcaagt

SEQ ID NO: 963708 - DNA, 25 bp, Mus musculus
tttacatgcactgaatgtggcaagt

SEQ ID NO: 963709 - DNA, 25 bp, Mus musculus
tttacatgctgactttaaagccagt

SEQ ID NO: 963710 - DNA, 25 bp, Mus musculus
tttacatgctgagtttaaagccagt

SEQ ID NO: 963711 - DNA, 25 bp, Mus musculus
tttacatggcgacggtgggtttctt

SEQ ID NO: 963712 - DNA, 25 bp, Mus musculus
tttacatggcgagggtgggtttctt

SEQ ID NO: 963713 - DNA, 25 bp, Mus musculus
tttacatgtatgagtgcgttgcctg

SEQ ID NO: 963714 - DNA, 25 bp, Mus musculus
tttacatgtatgtgtgcgttgcctg

SEQ ID NO: 963715 - DNA, 25 bp, Mus musculus
tttacatgttaaaactgccaccaaa

SEQ ID NO: 963716 - DNA, 25 bp, Mus musculus
tttacatgttaatactgccaccaaa

SEQ ID NO: 963717 - DNA, 25 bp, Mus musculus
tttacattaagaaactctgtcatcc

SEQ ID NO: 963718 - DNA, 25 bp, Mus musculus
tttacattaagatactctgtcatcc

SEQ ID NO: 963719 - DNA, 25 bp, Mus musculus
tttacattccctctttttcacttct

SEQ ID NO: 963720 - DNA, 25 bp, Mus musculus
tttacattccctgtttttcacttct

SEQ ID NO: 963721 - DNA, 25 bp, Mus musculus
tttacattcgcacctgagtggcttc

SEQ ID NO: 963722 - DNA, 25 bp, Mus musculus
tttacattcgcagctgagtggcttc

SEQ ID NO: 963723 - DNA, 25 bp, Mus musculus
tttacattctgcacccttccaggaa

SEQ ID NO: 963724 - DNA, 25 bp, Mus musculus
tttacattctgctcccttccaggaa

SEQ ID NO: 963725 - DNA, 25 bp, Mus musculus
tttacattgctcattactctgtggg

SEQ ID NO: 963726 - DNA, 25 bp, Mus musculus
tttacattgctctttactctgtggg

SEQ ID NO: 963727 - DNA, 25 bp, Mus musculus
tttacatttaagagccctgtgccta

SEQ ID NO: 963728 - DNA, 25 bp, Mus musculus
tttacatttaagtgccctgtgccta

SEQ ID NO: 963729 - DNA, 25 bp, Mus musculus
tttacatttagaatcccacagaaaa

SEQ ID NO: 963730 - DNA, 25 bp, Mus musculus
tttacatttagattcccacagaaaa

SEQ ID NO: 963731 - DNA, 25 bp, Mus musculus
tttacatttcccaatgctctgtgaa

SEQ ID NO: 963732 - DNA, 25 bp, Mus musculus
tttacatttccctatgctctgtgaa

SEQ ID NO: 963733 - DNA, 25 bp, Mus musculus
tttacatttctgattcgtttgagga

SEQ ID NO: 963734 - DNA, 25 bp, Mus musculus
tttacatttctgtttcgtttgagga

SEQ ID NO: 963735 - DNA, 25 bp, Mus musculus
tttacatttgagatgagcccctgcc

SEQ ID NO: 963736 - DNA, 25 bp, Mus musculus
tttacatttgagttgagcccctgcc

SEQ ID NO: 963737 - DNA, 25 bp, Mus musculus
tttaccaaagagcactctgcatgag

SEQ ID NO: 963738 - DNA, 25 bp, Mus musculus
tttaccaaagaggactctgcatgag

SEQ ID NO: 963739 - DNA, 25 bp, Mus musculus
tttaccaaattgatccagtttgtcc

SEQ ID NO: 963740 - DNA, 25 bp, Mus musculus
tttaccaaattgttccagtttgtcc

SEQ ID NO: 963741 - DNA, 25 bp, Mus musculus
tttaccaagagacgctttttagcct

SEQ ID NO: 963742 - DNA, 25 bp, Mus musculus
tttaccaagagaggctttttagcct

SEQ ID NO: 963743 - DNA, 25 bp, Mus musculus
tttaccaagcacctagtccttatgt

SEQ ID NO: 963744 - DNA, 25 bp, Mus musculus
tttaccaagcacgtagtccttatgt

SEQ ID NO: 963745 - DNA, 25 bp, Mus musculus
tttaccaaggagaggcccgtctcct

SEQ ID NO: 963746 - DNA, 25 bp, Mus musculus
tttaccaaggagtggcccgtctcct

SEQ ID NO: 963747 - DNA, 25 bp, Mus musculus
tttaccaaggtactgcatgactgtg

SEQ ID NO: 963748 - DNA, 25 bp, Mus musculus
tttaccaaggtagtgcatgactgtg

SEQ ID NO: 963749 - DNA, 25 bp, Mus musculus
tttaccaaggtcaccctgggctgtc

SEQ ID NO: 963750 - DNA, 25 bp, Mus musculus
tttaccaaggtctccctgggctgtc

SEQ ID NO: 963751 - DNA, 25 bp, Mus musculus
tttaccaagtccatgtgtgaatgat

SEQ ID NO: 963752 - DNA, 25 bp, Mus musculus
tttaccaagtccttgtgtgaatgat

SEQ ID NO: 963753 - DNA, 25 bp, Mus musculus
tttaccaagtttcctcgctgtcata

SEQ ID NO: 963754 - DNA, 25 bp, Mus musculus
tttaccaagtttgctcgctgtcata

SEQ ID NO: 963755 - DNA, 25 bp, Mus musculus
tttaccaatcatcccacacaagcgt

SEQ ID NO: 963756 - DNA, 25 bp, Mus musculus
tttaccaatcatgccacacaagcgt

SEQ ID NO: 963757 - DNA, 25 bp, Mus musculus
tttaccaattgacccttgcacgtct

SEQ ID NO: 963758 - DNA, 25 bp, Mus musculus
tttaccaattgagccttgcacgtct

SEQ ID NO: 963759 - DNA, 25 bp, Mus musculus
tttaccacaggcctacagagttttc

SEQ ID NO: 963760 - DNA, 25 bp, Mus musculus
tttaccacaggcgtacagagttttc

SEQ ID NO: 963761 - DNA, 25 bp, Mus musculus
tttaccacaggtatgagtctcactg

SEQ ID NO: 963762 - DNA, 25 bp, Mus musculus
tttaccacaggtttgagtctcactg

SEQ ID NO: 963763 - DNA, 25 bp, Mus musculus
tttaccacattgctgctggctatag

SEQ ID NO: 963764 - DNA, 25 bp, Mus musculus
tttaccacattggtgctggctatag

SEQ ID NO: 963765 - DNA, 25 bp, Mus musculus
tttaccaccaaacctaaagcctgca

SEQ ID NO: 963766 - DNA, 25 bp, Mus musculus
tttaccaccaaagctaaagcctgca

SEQ ID NO: 963767 - DNA, 25 bp, Mus musculus
tttaccaccaagaggcaggagtctc

SEQ ID NO: 963768 - DNA, 25 bp, Mus musculus
tttaccaccaagtggcaggagtctc

SEQ ID NO: 963769 - DNA, 25 bp, Mus musculus
tttaccaccaccagccattatgctt

SEQ ID NO: 963770 - DNA, 25 bp, Mus musculus
tttaccaccacctgccattatgctt

SEQ ID NO: 963771 - DNA, 25 bp, Mus musculus
tttaccacccttacctagagaggat

SEQ ID NO: 963772 - DNA, 25 bp, Mus musculus
tttaccaccctttcctagagaggat

SEQ ID NO: 963773 - DNA, 25 bp, Mus musculus
tttaccaccgccaccattaagatga

SEQ ID NO: 963774 - DNA, 25 bp, Mus musculus
tttaccaccgcctccattaagatga

SEQ ID NO: 963775 - DNA, 25 bp, Mus musculus
tttaccacggctcgctaaggctgca

SEQ ID NO: 963776 - DNA, 25 bp, Mus musculus
tttaccacggctggctaaggctgca

SEQ ID NO: 963777 - DNA, 25 bp, Mus musculus
tttaccactgccaatctgtgtgatg

SEQ ID NO: 963778 - DNA, 25 bp, Mus musculus
tttaccactgcctatctgtgtgatg

SEQ ID NO: 963779 - DNA, 25 bp, Mus musculus
tttaccactggtatcatagcactgt

SEQ ID NO: 963780 - DNA, 25 bp, Mus musculus
tttaccactggtttcatagcactgt

SEQ ID NO: 963781 - DNA, 25 bp, Mus musculus
tttaccacttctactcataagagga

SEQ ID NO: 963782 - DNA, 25 bp, Mus musculus
tttaccacttcttctcataagagga

SEQ ID NO: 963783 - DNA, 25 bp, Mus musculus
tttaccagaaatactctcagccagt

SEQ ID NO: 963784 - DNA, 25 bp, Mus musculus
tttaccagaaattctctcagccagt

SEQ ID NO: 963785 - DNA, 25 bp, Mus musculus
tttaccagactgagcctaatgattt

SEQ ID NO: 963786 - DNA, 25 bp, Mus musculus
tttaccagactgtgcctaatgattt

SEQ ID NO: 963787 - DNA, 25 bp, Mus musculus
tttaccagcactaaaggtgccgccg

SEQ ID NO: 963788 - DNA, 25 bp, Mus musculus
tttaccagcacttaaggtgccgccg

SEQ ID NO: 963789 - DNA, 25 bp, Mus musculus
tttaccagcgggaaagcggccagca

SEQ ID NO: 963790 - DNA, 25 bp, Mus musculus
tttaccagcgggtaagcggccagca

SEQ ID NO: 963791 - DNA, 25 bp, Mus musculus
tttaccagcgttctcttttgtcatg

SEQ ID NO: 963792 - DNA, 25 bp, Mus musculus
tttaccagcgttgtcttttgtcatg

SEQ ID NO: 963793 - DNA, 25 bp, Mus musculus
tttaccagctaactgactgccacgc

SEQ ID NO: 963794 - DNA, 25 bp, Mus musculus
tttaccagctaagtgactgccacgc

SEQ ID NO: 963795 - DNA, 25 bp, Mus musculus
tttaccagcttgagtggtgcctcaa

SEQ ID NO: 963796 - DNA, 25 bp, Mus musculus
tttaccagcttgtgtggtgcctcaa

SEQ ID NO: 963797 - DNA, 25 bp, Mus musculus
tttaccaggcaacgctggaactcgg

SEQ ID NO: 963798 - DNA, 25 bp, Mus musculus
tttaccaggcaaggctggaactcgg

SEQ ID NO: 963799 - DNA, 25 bp, Mus musculus
tttaccaggcctcattcaggacgtt

SEQ ID NO: 963800 - DNA, 25 bp, Mus musculus
tttaccaggcctgattcaggacgtt

SEQ ID NO: 963801 - DNA, 25 bp, Mus musculus
tttaccagtagcagattaccttcct

SEQ ID NO: 963802 - DNA, 25 bp, Mus musculus
tttaccagtagctgattaccttcct

SEQ ID NO: 963803 - DNA, 25 bp, Mus musculus
tttaccagtctacatgccaggtcat

SEQ ID NO: 963804 - DNA, 25 bp, Mus musculus
tttaccagtctagatgccaggtcat

SEQ ID NO: 963805 - DNA, 25 bp, Mus musculus
tttaccagtctgcagagctgcgtct

SEQ ID NO: 963806 - DNA, 25 bp, Mus musculus
tttaccagtctggagagctgcgtct

SEQ ID NO: 963807 - DNA, 25 bp, Mus musculus
tttaccagttttaactgtgcctgcc

SEQ ID NO: 963808 - DNA, 25 bp, Mus musculus
tttaccagtttttactgtgcctgcc

SEQ ID NO: 963809 - DNA, 25 bp, Mus musculus
tttaccatagcacatcatcagtgag

SEQ ID NO: 963810 - DNA, 25 bp, Mus musculus
tttaccatagcagatcatcagtgag

SEQ ID NO: 963811 - DNA, 25 bp, Mus musculus
tttaccatcaaccttttaataaatg

SEQ ID NO: 963812 - DNA, 25 bp, Mus musculus
tttaccatcaacgttttaataaatg

SEQ ID NO: 963813 - DNA, 25 bp, Mus musculus
tttaccatcagaaccacggagttga

SEQ ID NO: 963814 - DNA, 25 bp, Mus musculus
tttaccatcagatccacggagttga

SEQ ID NO: 963815 - DNA, 25 bp, Mus musculus
tttaccatcagcaaagcacgcttct

SEQ ID NO: 963816 - DNA, 25 bp, Mus musculus
tttaccatcagctaagcacgcttct

SEQ ID NO: 963817 - DNA, 25 bp, Mus musculus
tttaccatcgagatccaagcttgga

SEQ ID NO: 963818 - DNA, 25 bp, Mus musculus
tttaccatcgagttccaagcttgga

SEQ ID NO: 963819 - DNA, 25 bp, Mus musculus
tttaccatctagatacaatctttta

SEQ ID NO: 963820 - DNA, 25 bp, Mus musculus
tttaccatctagttacaatctttta

SEQ ID NO: 963821 - DNA, 25 bp, Mus musculus
tttaccatcttcactgtattgccac

SEQ ID NO: 963822 - DNA, 25 bp, Mus musculus
tttaccatcttctctgtattgccac

SEQ ID NO: 963823 - DNA, 25 bp, Mus musculus
tttaccatgaaaattccctcgctgc

SEQ ID NO: 963824 - DNA, 25 bp, Mus musculus
tttaccatgaaatttccctcgctgc

SEQ ID NO: 963825 - DNA, 25 bp, Mus musculus
tttaccatgtcgctgctgggaacaa

SEQ ID NO: 963826 - DNA, 25 bp, Mus musculus
tttaccatgtcggtgctgggaacaa

SEQ ID NO: 963827 - DNA, 25 bp, Mus musculus
tttaccatgttcacgaggttcctga

SEQ ID NO: 963828 - DNA, 25 bp, Mus musculus
tttaccatgttctcgaggttcctga

SEQ ID NO: 963829 - DNA, 25 bp, Mus musculus
tttaccattaaacacctcattataa

SEQ ID NO: 963830 - DNA, 25 bp, Mus musculus
tttaccattaaagacctcattataa

SEQ ID NO: 963831 - DNA, 25 bp, Mus musculus
tttaccattactataattcttcaat

SEQ ID NO: 963832 - DNA, 25 bp, Mus musculus
tttaccattactttaattcttcaat

SEQ ID NO: 963833 - DNA, 25 bp, Mus musculus
tttaccattctcagtagccacccag

SEQ ID NO: 963834 - DNA, 25 bp, Mus musculus
tttaccattctctgtagccacccag

SEQ ID NO: 963835 - DNA, 25 bp, Mus musculus
tttacccaacagagactccaggaga

SEQ ID NO: 963836 - DNA, 25 bp, Mus musculus
tttacccaacagtgactccaggaga

SEQ ID NO: 963837 - DNA, 25 bp, Mus musculus
tttacccaagccatgtgacatttcc

SEQ ID NO: 963838 - DNA, 25 bp, Mus musculus
tttacccaagccttgtgacatttcc

SEQ ID NO: 963839 - DNA, 25 bp, Mus musculus
tttacccaatgtagctgatattttt

SEQ ID NO: 963840 - DNA, 25 bp, Mus musculus
tttacccaatgttgctgatattttt

SEQ ID NO: 963841 - DNA, 25 bp, Mus musculus
tttacccacactcaggacctagtct

SEQ ID NO: 963842 - DNA, 25 bp, Mus musculus
tttacccacactgaggacctagtct

SEQ ID NO: 963843 - DNA, 25 bp, Mus musculus
tttacccacagcatcctgactgtga

SEQ ID NO: 963844 - DNA, 25 bp, Mus musculus
tttacccacagcttcctgactgtga

SEQ ID NO: 963845 - DNA, 25 bp, Mus musculus
tttacccacatcatttcaataatag

SEQ ID NO: 963846 - DNA, 25 bp, Mus musculus
tttacccacatcttttcaataatag

SEQ ID NO: 963847 - DNA, 25 bp, Mus musculus
tttacccaccatctgagaagacgca

SEQ ID NO: 963848 - DNA, 25 bp, Mus musculus
tttacccaccatgtgagaagacgca

SEQ ID NO: 963849 - DNA, 25 bp, Mus musculus
tttacccacccacctatgaattttg

SEQ ID NO: 963850 - DNA, 25 bp, Mus musculus
tttacccacccagctatgaattttg

SEQ ID NO: 963851 - DNA, 25 bp, Mus musculus
tttacccacgcacttgagagcacag

SEQ ID NO: 963852 - DNA, 25 bp, Mus musculus
tttacccacgcagttgagagcacag

SEQ ID NO: 963853 - DNA, 25 bp, Mus musculus
tttacccactggcagtctcatggtg

SEQ ID NO: 963854 - DNA, 25 bp, Mus musculus
tttacccactgggagtctcatggtg

SEQ ID NO: 963855 - DNA, 25 bp, Mus musculus
tttacccagaagcaatctcggccat

SEQ ID NO: 963856 - DNA, 25 bp, Mus musculus
tttacccagaaggaatctcggccat

SEQ ID NO: 963857 - DNA, 25 bp, Mus musculus
tttacccagattatcagtttgtact

SEQ ID NO: 963858 - DNA, 25 bp, Mus musculus
tttacccagattttcagtttgtact

SEQ ID NO: 963859 - DNA, 25 bp, Mus musculus
tttacccaggataggtttagtcaat

SEQ ID NO: 963860 - DNA, 25 bp, Mus musculus
tttacccaggattggtttagtcaat

SEQ ID NO: 963861 - DNA, 25 bp, Mus musculus
tttacccagggcactctggaaggac

SEQ ID NO: 963862 - DNA, 25 bp, Mus musculus
tttacccagggctctctggaaggac

SEQ ID NO: 963863 - DNA, 25 bp, Mus musculus
tttacccagtccattgtcactgatg

SEQ ID NO: 963864 - DNA, 25 bp, Mus musculus
tttacccagtcctttgtcactgatg

SEQ ID NO: 963865 - DNA, 25 bp, Mus musculus
tttacccatacaaaggagaccacaa

SEQ ID NO: 963866 - DNA, 25 bp, Mus musculus
tttacccatacataggagaccacaa

SEQ ID NO: 963867 - DNA, 25 bp, Mus musculus
tttacccattccatgacctagcaaa

SEQ ID NO: 963868 - DNA, 25 bp, Mus musculus
tttacccattccttgacctagcaaa

SEQ ID NO: 963869 - DNA, 25 bp, Mus musculus
tttacccattttctcctactgtact

SEQ ID NO: 963870 - DNA, 25 bp, Mus musculus
tttacccattttgtcctactgtact

SEQ ID NO: 963871 - DNA, 25 bp, Mus musculus
tttaccccagaaaatctccatctgc

SEQ ID NO: 963872 - DNA, 25 bp, Mus musculus
tttaccccagaatatctccatctgc

SEQ ID NO: 963873 - DNA, 25 bp, Mus musculus
tttaccccagcaaggttgtaatttt

SEQ ID NO: 963874 - DNA, 25 bp, Mus musculus
tttaccccagcacagtgaggacttc

SEQ ID NO: 963875 - DNA, 25 bp, Mus musculus
tttaccccagcagagtgaggacttc

SEQ ID NO: 963876 - DNA, 25 bp, Mus musculus
tttaccccagcatggttgtaatttt

SEQ ID NO: 963877 - DNA, 25 bp, Mus musculus
tttaccccagccactggagaccaga

SEQ ID NO: 963878 - DNA, 25 bp, Mus musculus
tttaccccagcctctggagaccaga

SEQ ID NO: 963879 - DNA, 25 bp, Mus musculus
tttaccccagttataggcagatatg

SEQ ID NO: 963880 - DNA, 25 bp, Mus musculus
tttaccccagttttaggcagatatg

SEQ ID NO: 963881 - DNA, 25 bp, Mus musculus
tttaccccgatgaatcacgctgtga

SEQ ID NO: 963882 - DNA, 25 bp, Mus musculus
tttaccccgatgtatcacgctgtga

SEQ ID NO: 963883 - DNA, 25 bp, Mus musculus
tttacccctactaacaaatgaggag

SEQ ID NO: 963884 - DNA, 25 bp, Mus musculus
tttacccctacttacaaatgaggag

SEQ ID NO: 963885 - DNA, 25 bp, Mus musculus
tttacccctctcagatcacagtaat

SEQ ID NO: 963886 - DNA, 25 bp, Mus musculus
tttacccctctctgatcacagtaat

SEQ ID NO: 963887 - DNA, 25 bp, Mus musculus
tttacccctgagctgtatcattggc

SEQ ID NO: 963888 - DNA, 25 bp, Mus musculus
tttacccctgaggtgtatcattggc

SEQ ID NO: 963889 - DNA, 25 bp, Mus musculus
tttacccgcaaacaaattatcaacg

SEQ ID NO: 963890 - DNA, 25 bp, Mus musculus
tttacccgcaaagaaattatcaacg

SEQ ID NO: 963891 - DNA, 25 bp, Mus musculus
tttacccgcggaagcaccttactgg

SEQ ID NO: 963892 - DNA, 25 bp, Mus musculus
tttacccgcggatgcaccttactgg

SEQ ID NO: 963893 - DNA, 25 bp, Mus musculus
tttacccgtcgcaggctaatattca

SEQ ID NO: 963894 - DNA, 25 bp, Mus musculus
tttacccgtcgctggctaatattca

SEQ ID NO: 963895 - DNA, 25 bp, Mus musculus
tttacccgtggactgcaactttgag

SEQ ID NO: 963896 - DNA, 25 bp, Mus musculus
tttacccgtggagtgcaactttgag

SEQ ID NO: 963897 - DNA, 25 bp, Mus musculus
tttacccgtgggatgcaataggcca

SEQ ID NO: 963898 - DNA, 25 bp, Mus musculus
tttacccgtgggttgcaataggcca

SEQ ID NO: 963899 - DNA, 25 bp, Mus musculus
tttaccctacgcctatgcaaatgtt

SEQ ID NO: 963900 - DNA, 25 bp, Mus musculus
tttaccctacgcgtatgcaaatgtt

SEQ ID NO: 963901 - DNA, 25 bp, Mus musculus
tttaccctctctccttatttattct

SEQ ID NO: 963902 - DNA, 25 bp, Mus musculus
tttaccctctctgcttatttattct

SEQ ID NO: 963903 - DNA, 25 bp, Mus musculus
tttaccctgaagaaatactagcatt

SEQ ID NO: 963904 - DNA, 25 bp, Mus musculus
tttaccctgaagtaatactagcatt

SEQ ID NO: 963905 - DNA, 25 bp, Mus musculus
tttaccctgactcattccttactgg

SEQ ID NO: 963906 - DNA, 25 bp, Mus musculus
tttaccctgactgattccttactgg

SEQ ID NO: 963907 - DNA, 25 bp, Mus musculus
tttaccctgcaaaccgtgaaataga

SEQ ID NO: 963908 - DNA, 25 bp, Mus musculus
tttaccctgcaatccgtgaaataga

SEQ ID NO: 963909 - DNA, 25 bp, Mus musculus
tttaccctgcccaaatccgttagtg

SEQ ID NO: 963910 - DNA, 25 bp, Mus musculus
tttaccctgccctaatccgttagtg

SEQ ID NO: 963911 - DNA, 25 bp, Mus musculus
tttaccctgcttaccaacatatgat

SEQ ID NO: 963912 - DNA, 25 bp, Mus musculus
tttaccctgctttccaacatatgat

SEQ ID NO: 963913 - DNA, 25 bp, Mus musculus
tttaccctggtacctgaactcaata

SEQ ID NO: 963914 - DNA, 25 bp, Mus musculus
tttaccctggtagctgaactcaata

SEQ ID NO: 963915 - DNA, 25 bp, Mus musculus
tttaccctgtagaacctgggcccat

SEQ ID NO: 963916 - DNA, 25 bp, Mus musculus
tttaccctgtagtacctgggcccat

SEQ ID NO: 963917 - DNA, 25 bp, Mus musculus
tttaccctgtccctcttttgtgtag

SEQ ID NO: 963918 - DNA, 25 bp, Mus musculus
tttaccctgtccgtcttttgtgtag

SEQ ID NO: 963919 - DNA, 25 bp, Mus musculus
tttaccctgtgccttaatgttgaat

SEQ ID NO: 963920 - DNA, 25 bp, Mus musculus
tttaccctgtgcgttaatgttgaat

SEQ ID NO: 963921 - DNA, 25 bp, Mus musculus
tttaccctgttaactcagactcaac

SEQ ID NO: 963922 - DNA, 25 bp, Mus musculus
tttaccctgttatctcagactcaac

SEQ ID NO: 963923 - DNA, 25 bp, Mus musculus
tttacccttaatatcacactgcctt

SEQ ID NO: 963924 - DNA, 25 bp, Mus musculus
tttacccttaatttcacactgcctt

SEQ ID NO: 963925 - DNA, 25 bp, Mus musculus
tttacccttacaacaattcaatgag

SEQ ID NO: 963926 - DNA, 25 bp, Mus musculus
tttacccttacatcaattcaatgag

SEQ ID NO: 963927 - DNA, 25 bp, Mus musculus
tttacccttcccaagcacaataaag

SEQ ID NO: 963928 - DNA, 25 bp, Mus musculus
tttacccttccctagcacaataaag

SEQ ID NO: 963929 - DNA, 25 bp, Mus musculus
tttacccttctaaatgacatgtctg

SEQ ID NO: 963930 - DNA, 25 bp, Mus musculus
tttacccttctatatgacatgtctg

SEQ ID NO: 963931 - DNA, 25 bp, Mus musculus
tttaccctttctcacgcatcctggt

SEQ ID NO: 963932 - DNA, 25 bp, Mus musculus
tttaccctttctgacgcatcctggt

SEQ ID NO: 963933 - DNA, 25 bp, Mus musculus
tttaccctttgtacctggacaggtg

SEQ ID NO: 963934 - DNA, 25 bp, Mus musculus
tttaccctttgttcctggacaggtg

SEQ ID NO: 963935 - DNA, 25 bp, Mus musculus
tttaccgagggaataacgcaatact

SEQ ID NO: 963936 - DNA, 25 bp, Mus musculus
tttaccgagggattaacgcaatact

SEQ ID NO: 963937 - DNA, 25 bp, Mus musculus
tttaccgatactacctgttcatggg

SEQ ID NO: 963938 - DNA, 25 bp, Mus musculus
tttaccgatacttcctgttcatggg

SEQ ID NO: 963939 - DNA, 25 bp, Mus musculus
tttaccgcacttatcctttaagact

SEQ ID NO: 963940 - DNA, 25 bp, Mus musculus
tttaccgcacttttcctttaagact

SEQ ID NO: 963941 - DNA, 25 bp, Mus musculus
tttaccgccagaagaaatcgaacag

SEQ ID NO: 963942 - DNA, 25 bp, Mus musculus
tttaccgccagatgaaatcgaacag

SEQ ID NO: 963943 - DNA, 25 bp, Mus musculus
tttaccgccagtacaaacaggagtt

SEQ ID NO: 963944 - DNA, 25 bp, Mus musculus
tttaccgccagttcaaacaggagtt

SEQ ID NO: 963945 - DNA, 25 bp, Mus musculus
tttaccggcactcggcactgaaaga

SEQ ID NO: 963946 - DNA, 25 bp, Mus musculus
tttaccggcactgggcactgaaaga

SEQ ID NO: 963947 - DNA, 25 bp, Mus musculus
tttaccgggacaacactctgagtat

SEQ ID NO: 963948 - DNA, 25 bp, Mus musculus
tttaccgggacatcactctgagtat

SEQ ID NO: 963949 - DNA, 25 bp, Mus musculus
tttaccgttttacatggaattctcg

SEQ ID NO: 963950 - DNA, 25 bp, Mus musculus
tttaccgttttagatggaattctcg

SEQ ID NO: 963951 - DNA, 25 bp, Mus musculus
tttacctacagaaagcttagtggct

SEQ ID NO: 963952 - DNA, 25 bp, Mus musculus
tttacctacagatagcttagtggct

SEQ ID NO: 963953 - DNA, 25 bp, Mus musculus
tttacctactgcatggctgtaaagg

SEQ ID NO: 963954 - DNA, 25 bp, Mus musculus
tttacctactgcttggctgtaaagg

SEQ ID NO: 963955 - DNA, 25 bp, Mus musculus
tttacctagagcaatgagttccatc

SEQ ID NO: 963956 - DNA, 25 bp, Mus musculus
tttacctagagctatgagttccatc

SEQ ID NO: 963957 - DNA, 25 bp, Mus musculus
tttacctagcagaagcttgaccctg

SEQ ID NO: 963958 - DNA, 25 bp, Mus musculus
tttacctagcagtagcttgaccctg

SEQ ID NO: 963959 - DNA, 25 bp, Mus musculus
tttacctagctgatttaataaactt

SEQ ID NO: 963960 - DNA, 25 bp, Mus musculus
tttacctagctgttttaataaactt

SEQ ID NO: 963961 - DNA, 25 bp, Mus musculus
tttacctatattagaaaacactgaa

SEQ ID NO: 963962 - DNA, 25 bp, Mus musculus
tttacctatatttgaaaacactgaa

SEQ ID NO: 963963 - DNA, 25 bp, Mus musculus
tttacctatgccattttgtgtcgat

SEQ ID NO: 963964 - DNA, 25 bp, Mus musculus
tttacctatgcctttttgtgtcgat

SEQ ID NO: 963965 - DNA, 25 bp, Mus musculus
tttacctatgggatgctgtagcatc

SEQ ID NO: 963966 - DNA, 25 bp, Mus musculus
tttacctatgggttgctgtagcatc

SEQ ID NO: 963967 - DNA, 25 bp, Mus musculus
tttacctcacttccaatgctgcctt

SEQ ID NO: 963968 - DNA, 25 bp, Mus musculus
tttacctcacttctttgccgtgtta

SEQ ID NO: 963969 - DNA, 25 bp, Mus musculus
tttacctcacttgcaatgctgcctt

SEQ ID NO: 963970 - DNA, 25 bp, Mus musculus
tttacctcacttgtttgccgtgtta

SEQ ID NO: 963971 - DNA, 25 bp, Mus musculus
tttacctcagatattcaaccagcag

SEQ ID NO: 963972 - DNA, 25 bp, Mus musculus
tttacctcagattttcaaccagcag

SEQ ID NO: 963973 - DNA, 25 bp, Mus musculus
tttacctcaggaagattgatgtgca

SEQ ID NO: 963974 - DNA, 25 bp, Mus musculus
tttacctcaggatgattgatgtgca

SEQ ID NO: 963975 - DNA, 25 bp, Mus musculus
tttacctcaggcaggagcaccatgg

SEQ ID NO: 963976 - DNA, 25 bp, Mus musculus
tttacctcaggctggagcaccatgg

SEQ ID NO: 963977 - DNA, 25 bp, Mus musculus
tttacctcatttacctgcgtgctta

SEQ ID NO: 963978 - DNA, 25 bp, Mus musculus
tttacctcattttcctgcgtgctta

SEQ ID NO: 963979 - DNA, 25 bp, Mus musculus
tttacctcccaactaacaaacatag

SEQ ID NO: 963980 - DNA, 25 bp, Mus musculus
tttacctcccaagtaacaaacatag

SEQ ID NO: 963981 - DNA, 25 bp, Mus musculus
tttacctcccctccaaattagcaga

SEQ ID NO: 963982 - DNA, 25 bp, Mus musculus
tttacctcccctgcaaattagcaga

SEQ ID NO: 963983 - DNA, 25 bp, Mus musculus
tttacctccggtatcagatttgata

SEQ ID NO: 963984 - DNA, 25 bp, Mus musculus
tttacctccggtttcagatttgata

SEQ ID NO: 963985 - DNA, 25 bp, Mus musculus
tttacctctattatactatcctctc

SEQ ID NO: 963986 - DNA, 25 bp, Mus musculus
tttacctctattttactatcctctc

SEQ ID NO: 963987 - DNA, 25 bp, Mus musculus
tttacctctctaatctccaattgca

SEQ ID NO: 963988 - DNA, 25 bp, Mus musculus
tttacctctctattctccaattgca

SEQ ID NO: 963989 - DNA, 25 bp, Mus musculus
tttacctctgacacccgtgagtagg

SEQ ID NO: 963990 - DNA, 25 bp, Mus musculus
tttacctctgactcccgtgagtagg

SEQ ID NO: 963991 - DNA, 25 bp, Mus musculus
tttacctctgtcacggatagcagct

SEQ ID NO: 963992 - DNA, 25 bp, Mus musculus
tttacctctgtctcggatagcagct

SEQ ID NO: 963993 - DNA, 25 bp, Mus musculus
tttacctcttgtcctggctttattt

SEQ ID NO: 963994 - DNA, 25 bp, Mus musculus
tttacctcttgtgctggctttattt

SEQ ID NO: 963995 - DNA, 25 bp, Mus musculus
tttacctgagcgcagagggtcgtcc

SEQ ID NO: 963996 - DNA, 25 bp, Mus musculus
tttacctgagcggagagggtcgtcc

SEQ ID NO: 963997 - DNA, 25 bp, Mus musculus
tttacctgattgaatgtatgccaca

SEQ ID NO: 963998 - DNA, 25 bp, Mus musculus
tttacctgattgtatgtatgccaca

SEQ ID NO: 963999 - DNA, 25 bp, Mus musculus
tttacctgcacccagaaagtcatct

SEQ ID NO: 964000 - DNA, 25 bp, Mus musculus
tttacctgcaccgagaaagtcatct

SEQ ID NO: 964001 - DNA, 25 bp, Mus musculus
tttacctgcatgagcgtgttgtgtt

SEQ ID NO: 964002 - DNA, 25 bp, Mus musculus
tttacctgcatgtgcgtgttgtgtt

SEQ ID NO: 964003 - DNA, 25 bp, Mus musculus
tttacctgccgactcatctaaccag

SEQ ID NO: 964004 - DNA, 25 bp, Mus musculus
tttacctgccgagtcatctaaccag

SEQ ID NO: 964005 - DNA, 25 bp, Mus musculus
tttacctgcctccttatactaacag

SEQ ID NO: 964006 - DNA, 25 bp, Mus musculus
tttacctgcctcgttatactaacag

SEQ ID NO: 964007 - DNA, 25 bp, Mus musculus
tttacctgctgtcggatgttgggaa

SEQ ID NO: 964008 - DNA, 25 bp, Mus musculus
tttacctgctgtgggatgttgggaa

SEQ ID NO: 964009 - DNA, 25 bp, Mus musculus
tttacctgcttgaatatctctgctc

SEQ ID NO: 964010 - DNA, 25 bp, Mus musculus
tttacctgcttgtatatctctgctc

SEQ ID NO: 964011 - DNA, 25 bp, Mus musculus
tttacctggagcagacactggtgtc

SEQ ID NO: 964012 - DNA, 25 bp, Mus musculus
tttacctggagctgacactggtgtc

SEQ ID NO: 964013 - DNA, 25 bp, Mus musculus
tttacctggcacaacggcaaacagt

SEQ ID NO: 964014 - DNA, 25 bp, Mus musculus
tttacctggcactacggcaaacagt

SEQ ID NO: 964015 - DNA, 25 bp, Mus musculus
tttacctggcttatcttgcaaaagg

SEQ ID NO: 964016 - DNA, 25 bp, Mus musculus
tttacctggcttttcttgcaaaagg

SEQ ID NO: 964017 - DNA, 25 bp, Mus musculus
tttacctgtaaccttgatacccata

SEQ ID NO: 964018 - DNA, 25 bp, Mus musculus
tttacctgtaacgttgatacccata

SEQ ID NO: 964019 - DNA, 25 bp, Mus musculus
tttacctgtatgctatcttcccttg

SEQ ID NO: 964020 - DNA, 25 bp, Mus musculus
tttacctgtatggtatcttcccttg

SEQ ID NO: 964021 - DNA, 25 bp, Mus musculus
tttacctgtcctacacttaaatcca

SEQ ID NO: 964022 - DNA, 25 bp, Mus musculus
tttacctgtccttcacttaaatcca

SEQ ID NO: 964023 - DNA, 25 bp, Mus musculus
tttacctgtgacatcatccttggcg

SEQ ID NO: 964024 - DNA, 25 bp, Mus musculus
tttacctgtgacttcatccttggcg

SEQ ID NO: 964025 - DNA, 25 bp, Mus musculus
tttacctgtgctatgatggtgccgt

SEQ ID NO: 964026 - DNA, 25 bp, Mus musculus
tttacctgtgctttgatggtgccgt

SEQ ID NO: 964027 - DNA, 25 bp, Mus musculus
tttacctgttgacctgtggcttcta

SEQ ID NO: 964028 - DNA, 25 bp, Mus musculus
tttacctgttgagctgtggcttcta

SEQ ID NO: 964029 - DNA, 25 bp, Mus musculus
tttaccttacatatggtcacagcat

SEQ ID NO: 964030 - DNA, 25 bp, Mus musculus
tttaccttacatttggtcacagcat

SEQ ID NO: 964031 - DNA, 25 bp, Mus musculus
tttaccttaccaaacatctttcttg

SEQ ID NO: 964032 - DNA, 25 bp, Mus musculus
tttaccttaccatacatctttcttg

SEQ ID NO: 964033 - DNA, 25 bp, Mus musculus
tttaccttcaacctgctagggcggg

SEQ ID NO: 964034 - DNA, 25 bp, Mus musculus
tttaccttcaacgtgctagggcggg

SEQ ID NO: 964035 - DNA, 25 bp, Mus musculus
tttaccttcagcacatgcagcttga

SEQ ID NO: 964036 - DNA, 25 bp, Mus musculus
tttaccttcagctcatgcagcttga

SEQ ID NO: 964037 - DNA, 25 bp, Mus musculus
tttaccttcaggaccaaacaggcaa

SEQ ID NO: 964038 - DNA, 25 bp, Mus musculus
tttaccttcaggtccaaacaggcaa

SEQ ID NO: 964039 - DNA, 25 bp, Mus musculus
tttaccttcctcctaggtgtcccag

SEQ ID NO: 964040 - DNA, 25 bp, Mus musculus
tttaccttcctcgtaggtgtcccag

SEQ ID NO: 964041 - DNA, 25 bp, Mus musculus
tttaccttcggaacatactgggagc

SEQ ID NO: 964042 - DNA, 25 bp, Mus musculus
tttaccttcggatcatactgggagc

SEQ ID NO: 964043 - DNA, 25 bp, Mus musculus
tttaccttctgcaggtgccctagca

SEQ ID NO: 964044 - DNA, 25 bp, Mus musculus
tttaccttctgctggtgccctagca

SEQ ID NO: 964045 - DNA, 25 bp, Mus musculus
tttaccttgacaacaaccagctcat

SEQ ID NO: 964046 - DNA, 25 bp, Mus musculus
tttaccttgacatcaaccagctcat

SEQ ID NO: 964047 - DNA, 25 bp, Mus musculus
tttaccttgcaccttcttcaggatt

SEQ ID NO: 964048 - DNA, 25 bp, Mus musculus
tttaccttgcacgttcttcaggatt

SEQ ID NO: 964049 - DNA, 25 bp, Mus musculus
tttaccttgcggagaacaatttcag

SEQ ID NO: 964050 - DNA, 25 bp, Mus musculus
tttaccttgcggtgaacaatttcag

SEQ ID NO: 964051 - DNA, 25 bp, Mus musculus
tttaccttgtacagactgcccgcct

SEQ ID NO: 964052 - DNA, 25 bp, Mus musculus
tttaccttgtactgactgcccgcct

SEQ ID NO: 964053 - DNA, 25 bp, Mus musculus
tttacctttaaacctcagctcggat

SEQ ID NO: 964054 - DNA, 25 bp, Mus musculus
tttacctttaaagctcagctcggat

SEQ ID NO: 964055 - DNA, 25 bp, Mus musculus
tttacctttaagacattacagtggg

SEQ ID NO: 964056 - DNA, 25 bp, Mus musculus
tttacctttaagtcattacagtggg

SEQ ID NO: 964057 - DNA, 25 bp, Mus musculus
tttacctttgccagggcatctgtta

SEQ ID NO: 964058 - DNA, 25 bp, Mus musculus
tttacctttgcctgggcatctgtta

SEQ ID NO: 964059 - DNA, 25 bp, Mus musculus
tttacctttgtaataaacatcctag

SEQ ID NO: 964060 - DNA, 25 bp, Mus musculus
tttacctttgtattaaacatcctag

SEQ ID NO: 964061 - DNA, 25 bp, Mus musculus
tttaccttttgccaatggttcaaag

SEQ ID NO: 964062 - DNA, 25 bp, Mus musculus
tttaccttttgcgaatggttcaaag

SEQ ID NO: 964063 - DNA, 25 bp, Mus musculus
tttacgaacttacatcgccagctct

SEQ ID NO: 964064 - DNA, 25 bp, Mus musculus
tttacgaacttagatcgccagctct

SEQ ID NO: 964065 - DNA, 25 bp, Mus musculus
tttacgaagcagcacatccaggaat

SEQ ID NO: 964066 - DNA, 25 bp, Mus musculus
tttacgaagcaggacatccaggaat

SEQ ID NO: 964067 - DNA, 25 bp, Mus musculus
tttacgaaggcccagagcaccaggt

SEQ ID NO: 964068 - DNA, 25 bp, Mus musculus
tttacgaaggccgagagcaccaggt

SEQ ID NO: 964069 - DNA, 25 bp, Mus musculus
tttacgagacgtaccttctgggatt

SEQ ID NO: 964070 - DNA, 25 bp, Mus musculus
tttacgagacgttccttctgggatt

SEQ ID NO: 964071 - DNA, 25 bp, Mus musculus
tttacgaggtaaccctggccttgaa

SEQ ID NO: 964072 - DNA, 25 bp, Mus musculus
tttacgaggtaagcctggccttgaa

SEQ ID NO: 964073 - DNA, 25 bp, Mus musculus
tttacgatatctccactatgtacct

SEQ ID NO: 964074 - DNA, 25 bp, Mus musculus
tttacgatatctgcactatgtacct

SEQ ID NO: 964075 - DNA, 25 bp, Mus musculus
tttacgcacatcacttccggaaagt

SEQ ID NO: 964076 - DNA, 25 bp, Mus musculus
tttacgcacatctcttccggaaagt

SEQ ID NO: 964077 - DNA, 25 bp, Mus musculus
tttacgcagtgactgcaaggcaggt

SEQ ID NO: 964078 - DNA, 25 bp, Mus musculus
tttacgcagtgagtgcaaggcaggt

SEQ ID NO: 964079 - DNA, 25 bp, Mus musculus
tttacgcatcatcttcccttgagaa

SEQ ID NO: 964080 - DNA, 25 bp, Mus musculus
tttacgcatcatgttcccttgagaa

SEQ ID NO: 964081 - DNA, 25 bp, Mus musculus
tttacgccaagcatcctactgtagg

SEQ ID NO: 964082 - DNA, 25 bp, Mus musculus
tttacgccaagcttcctactgtagg

SEQ ID NO: 964083 - DNA, 25 bp, Mus musculus
tttacgccactacatcactatacag

SEQ ID NO: 964084 - DNA, 25 bp, Mus musculus
tttacgccactagatcactatacag

SEQ ID NO: 964085 - DNA, 25 bp, Mus musculus
tttacgcctggcagaggatggctgc

SEQ ID NO: 964086 - DNA, 25 bp, Mus musculus
tttacgcctggctgaggatggctgc

SEQ ID NO: 964087 - DNA, 25 bp, Mus musculus
tttacgcttattattcatggatcaa

SEQ ID NO: 964088 - DNA, 25 bp, Mus musculus
tttacgcttatttttcatggatcaa

SEQ ID NO: 964089 - DNA, 25 bp, Mus musculus
tttacggaagttcatctttgacaaa

SEQ ID NO: 964090 - DNA, 25 bp, Mus musculus
tttacggaagttgatctttgacaaa

SEQ ID NO: 964091 - DNA, 25 bp, Mus musculus
tttacggacaggcaatccgccaaga

SEQ ID NO: 964092 - DNA, 25 bp, Mus musculus
tttacggacagggaatccgccaaga

SEQ ID NO: 964093 - DNA, 25 bp, Mus musculus
tttacggacatgatgtgctcccttc

SEQ ID NO: 964094 - DNA, 25 bp, Mus musculus
tttacggacatgttgtgctcccttc

SEQ ID NO: 964095 - DNA, 25 bp, Mus musculus
tttacggagattcgcgctttgctat

SEQ ID NO: 964096 - DNA, 25 bp, Mus musculus
tttacggagattggcgctttgctat

SEQ ID NO: 964097 - DNA, 25 bp, Mus musculus
tttacggccccactcacttatgtat

SEQ ID NO: 964098 - DNA, 25 bp, Mus musculus
tttacggccccagtcacttatgtat

SEQ ID NO: 964099 - DNA, 25 bp, Mus musculus
tttacggcctgaacttcacttgtgg

SEQ ID NO: 964100 - DNA, 25 bp, Mus musculus
tttacggcctgatcttcacttgtgg

SEQ ID NO: 964101 - DNA, 25 bp, Mus musculus
tttacgggaacacagctccttcaga

SEQ ID NO: 964102 - DNA, 25 bp, Mus musculus
tttacgggaacagagctccttcaga

SEQ ID NO: 964103 - DNA, 25 bp, Mus musculus
tttacgggctctccctgtcagacag

SEQ ID NO: 964104 - DNA, 25 bp, Mus musculus
tttacgggctctgcctgtcagacag

SEQ ID NO: 964105 - DNA, 25 bp, Mus musculus
tttacggttgaaactgccagttata

SEQ ID NO: 964106 - DNA, 25 bp, Mus musculus
tttacggttgaatctgccagttata

SEQ ID NO: 964107 - DNA, 25 bp, Mus musculus
tttacgtcacaaagccatctatggg

SEQ ID NO: 964108 - DNA, 25 bp, Mus musculus
tttacgtcacaatgccatctatggg

SEQ ID NO: 964109 - DNA, 25 bp, Mus musculus
tttacgtcattgatttgtgttcacc

SEQ ID NO: 964110 - DNA, 25 bp, Mus musculus
tttacgtcattgttttgtgttcacc

SEQ ID NO: 964111 - DNA, 25 bp, Mus musculus
tttacgtgcgtcattacagtttcct

SEQ ID NO: 964112 - DNA, 25 bp, Mus musculus
tttacgtgcgtctttacagtttcct

SEQ ID NO: 964113 - DNA, 25 bp, Mus musculus
tttacgtggcgcattgtgacatgct

SEQ ID NO: 964114 - DNA, 25 bp, Mus musculus
tttacgtggcgctttgtgacatgct

SEQ ID NO: 964115 - DNA, 25 bp, Mus musculus
tttacgtgtgacatttgtgagatat

SEQ ID NO: 964116 - DNA, 25 bp, Mus musculus
tttacgtgtgacttttgtgagatat

SEQ ID NO: 964117 - DNA, 25 bp, Mus musculus
tttacgtgtttcaccgttctggcta

SEQ ID NO: 964118 - DNA, 25 bp, Mus musculus
tttacgtgtttctccgttctggcta

SEQ ID NO: 964119 - DNA, 25 bp, Mus musculus
tttacgttcgctcagtgcagaactg

SEQ ID NO: 964120 - DNA, 25 bp, Mus musculus
tttacgttcgctgagtgcagaactg

SEQ ID NO: 964121 - DNA, 25 bp, Mus musculus
tttacgttgccgaaacaagccatcg

SEQ ID NO: 964122 - DNA, 25 bp, Mus musculus
tttacgttgccgtaacaagccatcg

SEQ ID NO: 964123 - DNA, 25 bp, Mus musculus
tttacgttgctgattatatctctaa

SEQ ID NO: 964124 - DNA, 25 bp, Mus musculus
tttacgttgctgtttatatctctaa

SEQ ID NO: 964125 - DNA, 25 bp, Mus musculus
tttacgtttttgcttgtcaccttgt

SEQ ID NO: 964126 - DNA, 25 bp, Mus musculus
tttacgtttttggttgtcaccttgt

SEQ ID NO: 964127 - DNA, 25 bp, Mus musculus
tttactaactgacctgttttgggat

SEQ ID NO: 964128 - DNA, 25 bp, Mus musculus
tttactaactgagctgttttgggat

SEQ ID NO: 964129 - DNA, 25 bp, Mus musculus
tttactaagcctcttgaccctgatg

SEQ ID NO: 964130 - DNA, 25 bp, Mus musculus
tttactaagcctgttgaccctgatg

SEQ ID NO: 964131 - DNA, 25 bp, Mus musculus
tttactaatgttacaactttccaag

SEQ ID NO: 964132 - DNA, 25 bp, Mus musculus
tttactaatgtttcaactttccaag

SEQ ID NO: 964133 - DNA, 25 bp, Mus musculus
tttactacaagcaacagataacctg

SEQ ID NO: 964134 - DNA, 25 bp, Mus musculus
tttactacaagctacagataacctg

SEQ ID NO: 964135 - DNA, 25 bp, Mus musculus
tttactaccaagctctggacacggt

SEQ ID NO: 964136 - DNA, 25 bp, Mus musculus
tttactaccaaggtctggacacggt

SEQ ID NO: 964137 - DNA, 25 bp, Mus musculus
tttactacctggagggctggttgag

SEQ ID NO: 964138 - DNA, 25 bp, Mus musculus
tttactacctggtgggctggttgag

SEQ ID NO: 964139 - DNA, 25 bp, Mus musculus
tttactaccttcatgccttgggcag

SEQ ID NO: 964140 - DNA, 25 bp, Mus musculus
tttactaccttcttgccttgggcag

SEQ ID NO: 964141 - DNA, 25 bp, Mus musculus
tttactacgtagaatcccagggatt

SEQ ID NO: 964142 - DNA, 25 bp, Mus musculus
tttactacgtagtatcccagggatt

SEQ ID NO: 964143 - DNA, 25 bp, Mus musculus
tttactactaggatacagatattga

SEQ ID NO: 964144 - DNA, 25 bp, Mus musculus
tttactactaggttacagatattga

SEQ ID NO: 964145 - DNA, 25 bp, Mus musculus
tttactactcatctatcgtatgcta

SEQ ID NO: 964146 - DNA, 25 bp, Mus musculus
tttactactcatgtatcgtatgcta

SEQ ID NO: 964147 - DNA, 25 bp, Mus musculus
tttactactcttccataagacccag

SEQ ID NO: 964148 - DNA, 25 bp, Mus musculus
tttactactcttgcataagacccag

SEQ ID NO: 964149 - DNA, 25 bp, Mus musculus
tttactacttccatggaaccatctc

SEQ ID NO: 964150 - DNA, 25 bp, Mus musculus
tttactacttccttggaaccatctc

SEQ ID NO: 964151 - DNA, 25 bp, Mus musculus
tttactacttcgaaggccagggcgt

SEQ ID NO: 964152 - DNA, 25 bp, Mus musculus
tttactacttcgtaggccagggcgt

SEQ ID NO: 964153 - DNA, 25 bp, Mus musculus
tttactagatgtcccttgcccttca

SEQ ID NO: 964154 - DNA, 25 bp, Mus musculus
tttactagatgtgccttgcccttca

SEQ ID NO: 964155 - DNA, 25 bp, Mus musculus
tttactagtagtcttggtcaaagaa

SEQ ID NO: 964156 - DNA, 25 bp, Mus musculus
tttactagtagtgttggtcaaagaa

SEQ ID NO: 964157 - DNA, 25 bp, Mus musculus
tttactatcacaaaacaccactcct

SEQ ID NO: 964158 - DNA, 25 bp, Mus musculus
tttactatcacataacaccactcct

SEQ ID NO: 964159 - DNA, 25 bp, Mus musculus
tttactatccacacctaatgctgaa

SEQ ID NO: 964160 - DNA, 25 bp, Mus musculus
tttactatccactcctaatgctgaa

SEQ ID NO: 964161 - DNA, 25 bp, Mus musculus
tttactatcctcatcatcttgcttg

SEQ ID NO: 964162 - DNA, 25 bp, Mus musculus
tttactatcctcttcatcttgcttg

SEQ ID NO: 964163 - DNA, 25 bp, Mus musculus
tttactatctccaaacactctgact

SEQ ID NO: 964164 - DNA, 25 bp, Mus musculus
tttactatctcctaacactctgact

SEQ ID NO: 964165 - DNA, 25 bp, Mus musculus
tttactatgataatcttggactggc

SEQ ID NO: 964166 - DNA, 25 bp, Mus musculus
tttactatgatattcttggactggc

SEQ ID NO: 964167 - DNA, 25 bp, Mus musculus
tttactatgtaaatgcttgatggat

SEQ ID NO: 964168 - DNA, 25 bp, Mus musculus
tttactatgtaattgcttgatggat

SEQ ID NO: 964169 - DNA, 25 bp, Mus musculus
tttactattaatcgctcccctactt

SEQ ID NO: 964170 - DNA, 25 bp, Mus musculus
tttactattaatggctcccctactt

SEQ ID NO: 964171 - DNA, 25 bp, Mus musculus
tttactatttcaccactcagttata

SEQ ID NO: 964172 - DNA, 25 bp, Mus musculus
tttactatttcagcactcagttata

SEQ ID NO: 964173 - DNA, 25 bp, Mus musculus
tttactattttgaactagtcccgag

SEQ ID NO: 964174 - DNA, 25 bp, Mus musculus
tttactattttgtactagtcccgag

SEQ ID NO: 964175 - DNA, 25 bp, Mus musculus
tttactcacattagtttcctgcaat

SEQ ID NO: 964176 - DNA, 25 bp, Mus musculus
tttactcacatttgtttcctgcaat

SEQ ID NO: 964177 - DNA, 25 bp, Mus musculus
tttactcacctgaaaccctctgtct

SEQ ID NO: 964178 - DNA, 25 bp, Mus musculus
tttactcacctgtaaccctctgtct

SEQ ID NO: 964179 - DNA, 25 bp, Mus musculus
tttactcacttgagcaagatgacat

SEQ ID NO: 964180 - DNA, 25 bp, Mus musculus
tttactcacttgtgcaagatgacat

SEQ ID NO: 964181 - DNA, 25 bp, Mus musculus
tttactcagataaaaccagcgggct

SEQ ID NO: 964182 - DNA, 25 bp, Mus musculus
tttactcagatataaccagcgggct

SEQ ID NO: 964183 - DNA, 25 bp, Mus musculus
tttactcagggtcttctcaggcgtg

SEQ ID NO: 964184 - DNA, 25 bp, Mus musculus
tttactcagggtgttctcaggcgtg

SEQ ID NO: 964185 - DNA, 25 bp, Mus musculus
tttactcatcgtaaagtccttccct

SEQ ID NO: 964186 - DNA, 25 bp, Mus musculus
tttactcatcgttaagtccttccct

SEQ ID NO: 964187 - DNA, 25 bp, Mus musculus
tttactcattccactgtgggccacc

SEQ ID NO: 964188 - DNA, 25 bp, Mus musculus
tttactcattcctctgtgggccacc

SEQ ID NO: 964189 - DNA, 25 bp, Mus musculus
tttactccagacagaggctacccag

SEQ ID NO: 964190 - DNA, 25 bp, Mus musculus
tttactccagactgaggctacccag

SEQ ID NO: 964191 - DNA, 25 bp, Mus musculus
tttactccagccatggtcaggaagt

SEQ ID NO: 964192 - DNA, 25 bp, Mus musculus
tttactccagccttggtcaggaagt

SEQ ID NO: 964193 - DNA, 25 bp, Mus musculus
tttactccatgtaccagacacggat

SEQ ID NO: 964194 - DNA, 25 bp, Mus musculus
tttactccatgttccagacacggat

SEQ ID NO: 964195 - DNA, 25 bp, Mus musculus
tttactccctacctgagcatcatgg

SEQ ID NO: 964196 - DNA, 25 bp, Mus musculus
tttactccctacgtgagcatcatgg

SEQ ID NO: 964197 - DNA, 25 bp, Mus musculus
tttactccctgacccatcttttagg

SEQ ID NO: 964198 - DNA, 25 bp, Mus musculus
tttactccctgagccatcttttagg

SEQ ID NO: 964199 - DNA, 25 bp, Mus musculus
tttactccctttccttcatataatc

SEQ ID NO: 964200 - DNA, 25 bp, Mus musculus
tttactccctttgcttcatataatc

SEQ ID NO: 964201 - DNA, 25 bp, Mus musculus
tttactcctctgaaccatgaaccat

SEQ ID NO: 964202 - DNA, 25 bp, Mus musculus
tttactcctctgtaccatgaaccat

SEQ ID NO: 964203 - DNA, 25 bp, Mus musculus
tttactcctttgaagacatgactct

SEQ ID NO: 964204 - DNA, 25 bp, Mus musculus
tttactcctttgtagacatgactct

SEQ ID NO: 964205 - DNA, 25 bp, Mus musculus
tttactcgattgaaaccttagacag

SEQ ID NO: 964206 - DNA, 25 bp, Mus musculus
tttactcgattgtaaccttagacag

SEQ ID NO: 964207 - DNA, 25 bp, Mus musculus
tttactcgggcaaaggtgaggctga

SEQ ID NO: 964208 - DNA, 25 bp, Mus musculus
tttactcgggcataggtgaggctga

SEQ ID NO: 964209 - DNA, 25 bp, Mus musculus
tttactcggtagagtggatctggtg

SEQ ID NO: 964210 - DNA, 25 bp, Mus musculus
tttactcggtagtgtggatctggtg

SEQ ID NO: 964211 - DNA, 25 bp, Mus musculus
tttactcgtcgacagattgcacagt

SEQ ID NO: 964212 - DNA, 25 bp, Mus musculus
tttactcgtcgagagattgcacagt

SEQ ID NO: 964213 - DNA, 25 bp, Mus musculus
tttactctaacaagactctacccta

SEQ ID NO: 964214 - DNA, 25 bp, Mus musculus
tttactctaacatgactctacccta

SEQ ID NO: 964215 - DNA, 25 bp, Mus musculus
tttactctagagacacagtacacaa

SEQ ID NO: 964216 - DNA, 25 bp, Mus musculus
tttactctagagtcacagtacacaa

SEQ ID NO: 964217 - DNA, 25 bp, Mus musculus
tttactctcaagagttccctctatt

SEQ ID NO: 964218 - DNA, 25 bp, Mus musculus
tttactctcaagtgttccctctatt

SEQ ID NO: 964219 - DNA, 25 bp, Mus musculus
tttactctcctcatgtggacaaggg

SEQ ID NO: 964220 - DNA, 25 bp, Mus musculus
tttactctcctcttgtggacaaggg

SEQ ID NO: 964221 - DNA, 25 bp, Mus musculus
tttactctctgtccttcatcaccag

SEQ ID NO: 964222 - DNA, 25 bp, Mus musculus
tttactctctgtgcttcatcaccag

SEQ ID NO: 964223 - DNA, 25 bp, Mus musculus
tttactctgccacgtcaaacttatc

SEQ ID NO: 964224 - DNA, 25 bp, Mus musculus
tttactctgccaggtcaaacttatc

SEQ ID NO: 964225 - DNA, 25 bp, Mus musculus
tttactctgcgcacacagtttcaga

SEQ ID NO: 964226 - DNA, 25 bp, Mus musculus
tttactctgcgctcacagtttcaga

SEQ ID NO: 964227 - DNA, 25 bp, Mus musculus
tttactctgggtaaaggtttgctgt

SEQ ID NO: 964228 - DNA, 25 bp, Mus musculus
tttactctgggttaaggtttgctgt

SEQ ID NO: 964229 - DNA, 25 bp, Mus musculus
tttactcttaccatcagcagtgtac

SEQ ID NO: 964230 - DNA, 25 bp, Mus musculus
tttactcttaccttcagcagtgtac

SEQ ID NO: 964231 - DNA, 25 bp, Mus musculus
tttactcttcctagagtttgctcag

SEQ ID NO: 964232 - DNA, 25 bp, Mus musculus
tttactcttccttgagtttgctcag

SEQ ID NO: 964233 - DNA, 25 bp, Mus musculus
tttactcttctgattataagctgag

SEQ ID NO: 964234 - DNA, 25 bp, Mus musculus
tttactcttctgtttataagctgag

SEQ ID NO: 964235 - DNA, 25 bp, Mus musculus
tttactcttgaaccacgaacgattg

SEQ ID NO: 964236 - DNA, 25 bp, Mus musculus
tttactcttgaagcacgaacgattg

SEQ ID NO: 964237 - DNA, 25 bp, Mus musculus
tttactcttgggaacgcttacaggt

SEQ ID NO: 964238 - DNA, 25 bp, Mus musculus
tttactcttgggtacgcttacaggt

SEQ ID NO: 964239 - DNA, 25 bp, Mus musculus
tttactctttctaactgtgaataga

SEQ ID NO: 964240 - DNA, 25 bp, Mus musculus
tttactctttcttactgtgaataga

SEQ ID NO: 964241 - DNA, 25 bp, Mus musculus
tttactgaaactactgtctaggctg

SEQ ID NO: 964242 - DNA, 25 bp, Mus musculus
tttactgaaacttctgtctaggctg

SEQ ID NO: 964243 - DNA, 25 bp, Mus musculus
tttactgaaagaactcggccacgga

SEQ ID NO: 964244 - DNA, 25 bp, Mus musculus
tttactgaaagatctcggccacgga

SEQ ID NO: 964245 - DNA, 25 bp, Mus musculus
tttactgacttaagctgtctcccca

SEQ ID NO: 964246 - DNA, 25 bp, Mus musculus
tttactgacttatgctgtctcccca

SEQ ID NO: 964247 - DNA, 25 bp, Mus musculus
tttactgagtgcattcttcttagaa

SEQ ID NO: 964248 - DNA, 25 bp, Mus musculus
tttactgagtgctttcttcttagaa

SEQ ID NO: 964249 - DNA, 25 bp, Mus musculus
tttactgatcagctatggtggcagc

SEQ ID NO: 964250 - DNA, 25 bp, Mus musculus
tttactgatcaggtatggtggcagc

SEQ ID NO: 964251 - DNA, 25 bp, Mus musculus
tttactgatgttcgtgctggctgcc

SEQ ID NO: 964252 - DNA, 25 bp, Mus musculus
tttactgatgttggtgctggctgcc

SEQ ID NO: 964253 - DNA, 25 bp, Mus musculus
tttactgcaaaaattaccgaaccat

SEQ ID NO: 964254 - DNA, 25 bp, Mus musculus
tttactgcaaaatttaccgaaccat

SEQ ID NO: 964255 - DNA, 25 bp, Mus musculus
tttactgcagttattcaggagcgca

SEQ ID NO: 964256 - DNA, 25 bp, Mus musculus
tttactgcagtttttcaggagcgca

SEQ ID NO: 964257 - DNA, 25 bp, Mus musculus
tttactgcataacatttagcttttg

SEQ ID NO: 964258 - DNA, 25 bp, Mus musculus
tttactgcataagatttagcttttg

SEQ ID NO: 964259 - DNA, 25 bp, Mus musculus
tttactgcatccagctgaccctggg

SEQ ID NO: 964260 - DNA, 25 bp, Mus musculus
tttactgcatcctgctgaccctggg

SEQ ID NO: 964261 - DNA, 25 bp, Mus musculus
tttactgcattacctaaagcctgga

SEQ ID NO: 964262 - DNA, 25 bp, Mus musculus
tttactgcattagctaaagcctgga

SEQ ID NO: 964263 - DNA, 25 bp, Mus musculus
tttactgccctccagagcaatcagg

SEQ ID NO: 964264 - DNA, 25 bp, Mus musculus
tttactgccctcgagagcaatcagg

SEQ ID NO: 964265 - DNA, 25 bp, Mus musculus
tttactgccgagctgactgtacctt

SEQ ID NO: 964266 - DNA, 25 bp, Mus musculus
tttactgccgaggtgactgtacctt

SEQ ID NO: 964267 - DNA, 25 bp, Mus musculus
tttactgcctctctcctaaagaatt

SEQ ID NO: 964268 - DNA, 25 bp, Mus musculus
tttactgcctctgtcctaaagaatt

SEQ ID NO: 964269 - DNA, 25 bp, Mus musculus
tttactgcttcaactactgacacaa

SEQ ID NO: 964270 - DNA, 25 bp, Mus musculus
tttactgcttcatctactgacacaa

SEQ ID NO: 964271 - DNA, 25 bp, Mus musculus
tttactgctttcatcctaattctgc

SEQ ID NO: 964272 - DNA, 25 bp, Mus musculus
tttactgctttcttcctaattctgc

SEQ ID NO: 964273 - DNA, 25 bp, Mus musculus
tttactggacatcactttagctatc

SEQ ID NO: 964274 - DNA, 25 bp, Mus musculus
tttactggacatgactttagctatc

SEQ ID NO: 964275 - DNA, 25 bp, Mus musculus
tttactggaccacagtcttgctcat

SEQ ID NO: 964276 - DNA, 25 bp, Mus musculus
tttactggaccagagtcttgctcat

SEQ ID NO: 964277 - DNA, 25 bp, Mus musculus
tttactggattcacagggagccctc

SEQ ID NO: 964278 - DNA, 25 bp, Mus musculus
tttactggattctcagggagccctc

SEQ ID NO: 964279 - DNA, 25 bp, Mus musculus
tttactggccagcaagctttctcag

SEQ ID NO: 964280 - DNA, 25 bp, Mus musculus
tttactggccaggaagctttctcag

SEQ ID NO: 964281 - DNA, 25 bp, Mus musculus
tttactggccatatgaactctttgt

SEQ ID NO: 964282 - DNA, 25 bp, Mus musculus
tttactggccatttgaactctttgt

SEQ ID NO: 964283 - DNA, 25 bp, Mus musculus
tttactggccctaaatggctacaga

SEQ ID NO: 964284 - DNA, 25 bp, Mus musculus
tttactggcccttaatggctacaga

SEQ ID NO: 964285 - DNA, 25 bp, Mus musculus
tttactggctgaatgcgggcgacac

SEQ ID NO: 964286 - DNA, 25 bp, Mus musculus
tttactggctgattgcgggcgacac

SEQ ID NO: 964287 - DNA, 25 bp, Mus musculus
tttactgggcacatcattgtagaca

SEQ ID NO: 964288 - DNA, 25 bp, Mus musculus
tttactgggcacttcattgtagaca

SEQ ID NO: 964289 - DNA, 25 bp, Mus musculus
tttactgggctcctctgagtttgaa

SEQ ID NO: 964290 - DNA, 25 bp, Mus musculus
tttactgggctcgtctgagtttgaa

SEQ ID NO: 964291 - DNA, 25 bp, Mus musculus
tttactgggtttagcatttcaggac

SEQ ID NO: 964292 - DNA, 25 bp, Mus musculus
tttactgggttttgcatttcaggac

SEQ ID NO: 964293 - DNA, 25 bp, Mus musculus
tttactggtatcagcagcccagaga

SEQ ID NO: 964294 - DNA, 25 bp, Mus musculus
tttactggtatctgcagcccagaga

SEQ ID NO: 964295 - DNA, 25 bp, Mus musculus
tttactggttttcttactatggatt

SEQ ID NO: 964296 - DNA, 25 bp, Mus musculus
tttactggttttgttactatggatt

SEQ ID NO: 964297 - DNA, 25 bp, Mus musculus
tttactgtaaagcttgtgtgcccat

SEQ ID NO: 964298 - DNA, 25 bp, Mus musculus
tttactgtaaaggttgtgtgcccat

SEQ ID NO: 964299 - DNA, 25 bp, Mus musculus
tttactgtaaatccccgttatccca

SEQ ID NO: 964300 - DNA, 25 bp, Mus musculus
tttactgtaaatgcccgttatccca

SEQ ID NO: 964301 - DNA, 25 bp, Mus musculus
tttactgtacacctttgcctttaca

SEQ ID NO: 964302 - DNA, 25 bp, Mus musculus
tttactgtacacgtttgcctttaca

SEQ ID NO: 964303 - DNA, 25 bp, Mus musculus
tttactgtacagaccaggtgagacg

SEQ ID NO: 964304 - DNA, 25 bp, Mus musculus
tttactgtacagtccaggtgagacg

SEQ ID NO: 964305 - DNA, 25 bp, Mus musculus
tttactgtagtgcaacctgctacca

SEQ ID NO: 964306 - DNA, 25 bp, Mus musculus
tttactgtagtggaacctgctacca

SEQ ID NO: 964307 - DNA, 25 bp, Mus musculus
tttactgtcagaaagcatgtggtgc

SEQ ID NO: 964308 - DNA, 25 bp, Mus musculus
tttactgtcagatagcatgtggtgc

SEQ ID NO: 964309 - DNA, 25 bp, Mus musculus
tttactgtgctgaacggaacctttg

SEQ ID NO: 964310 - DNA, 25 bp, Mus musculus
tttactgtgctgtacggaacctttg

SEQ ID NO: 964311 - DNA, 25 bp, Mus musculus
tttactgtgtacatttttcagagcc

SEQ ID NO: 964312 - DNA, 25 bp, Mus musculus
tttactgtgtacttttttcagagcc

SEQ ID NO: 964313 - DNA, 25 bp, Mus musculus
tttactgtgtttcacttaaattagt

SEQ ID NO: 964314 - DNA, 25 bp, Mus musculus
tttactgtgtttgacttaaattagt

SEQ ID NO: 964315 - DNA, 25 bp, Mus musculus
tttactgttctcctgggcattgcca

SEQ ID NO: 964316 - DNA, 25 bp, Mus musculus
tttactgttctcgtgggcattgcca

SEQ ID NO: 964317 - DNA, 25 bp, Mus musculus
tttactgttcttatcagtggactct

SEQ ID NO: 964318 - DNA, 25 bp, Mus musculus
tttactgttcttctagtggacctca

SEQ ID NO: 964319 - DNA, 25 bp, Mus musculus
tttactgttcttgtagtggacctca

SEQ ID NO: 964320 - DNA, 25 bp, Mus musculus
tttactgttcttttcagtggactct

SEQ ID NO: 964321 - DNA, 25 bp, Mus musculus
tttactgttgaaagctcccacttaa

SEQ ID NO: 964322 - DNA, 25 bp, Mus musculus
tttactgttgaatgctcccacttaa

SEQ ID NO: 964323 - DNA, 25 bp, Mus musculus
tttactgttgttcacatcctcacag

SEQ ID NO: 964324 - DNA, 25 bp, Mus musculus
tttactgttgttccgtaaacctgag

SEQ ID NO: 964325 - DNA, 25 bp, Mus musculus
tttactgttgttgacatcctcacag

SEQ ID NO: 964326 - DNA, 25 bp, Mus musculus
tttactgttgttgcgtaaacctgag

SEQ ID NO: 964327 - DNA, 25 bp, Mus musculus
tttactgtttaaattcctgtgtgtg

SEQ ID NO: 964328 - DNA, 25 bp, Mus musculus
tttactgtttaatttcctgtgtgtg

SEQ ID NO: 964329 - DNA, 25 bp, Mus musculus
tttactgtttctctggcgtgtgcag

SEQ ID NO: 964330 - DNA, 25 bp, Mus musculus
tttactgtttctgtggcgtgtgcag

SEQ ID NO: 964331 - DNA, 25 bp, Mus musculus
tttactgtttgtagcttccaagcac

SEQ ID NO: 964332 - DNA, 25 bp, Mus musculus
tttactgtttgttgcttccaagcac

SEQ ID NO: 964333 - DNA, 25 bp, Mus musculus
tttacttaaccacctataaaatgga

SEQ ID NO: 964334 - DNA, 25 bp, Mus musculus
tttacttaaccagctataaaatgga

SEQ ID NO: 964335 - DNA, 25 bp, Mus musculus
tttacttaacccacatcctcagaaa

SEQ ID NO: 964336 - DNA, 25 bp, Mus musculus
tttacttaaccctcatcctcagaaa

SEQ ID NO: 964337 - DNA, 25 bp, Mus musculus
tttacttacaagagcctttttgcca

SEQ ID NO: 964338 - DNA, 25 bp, Mus musculus
tttacttacaagtgcctttttgcca

SEQ ID NO: 964339 - DNA, 25 bp, Mus musculus
tttacttactggattgcccttgcac

SEQ ID NO: 964340 - DNA, 25 bp, Mus musculus
tttacttactggtttgcccttgcac

SEQ ID NO: 964341 - DNA, 25 bp, Mus musculus
tttacttactttatatactacactg

SEQ ID NO: 964342 - DNA, 25 bp, Mus musculus
tttacttactttttatactacactg

SEQ ID NO: 964343 - DNA, 25 bp, Mus musculus
tttacttagaacaattcccgctctg

SEQ ID NO: 964344 - DNA, 25 bp, Mus musculus
tttacttagaactattcccgctctg

SEQ ID NO: 964345 - DNA, 25 bp, Mus musculus
tttacttagctcattgattctgtca

SEQ ID NO: 964346 - DNA, 25 bp, Mus musculus
tttacttagctctttgattctgtca

SEQ ID NO: 964347 - DNA, 25 bp, Mus musculus
tttacttagtttcacattcttcctt

SEQ ID NO: 964348 - DNA, 25 bp, Mus musculus
tttacttagtttgacattcttcctt

SEQ ID NO: 964349 - DNA, 25 bp, Mus musculus
tttacttatggcactggtatctcat

SEQ ID NO: 964350 - DNA, 25 bp, Mus musculus
tttacttatggctctggtatctcat

SEQ ID NO: 964351 - DNA, 25 bp, Mus musculus
tttacttattaaatcccctcatcat

SEQ ID NO: 964352 - DNA, 25 bp, Mus musculus
tttacttattaattcccctcatcat

SEQ ID NO: 964353 - DNA, 25 bp, Mus musculus
tttacttcagtgcttactttcctca

SEQ ID NO: 964354 - DNA, 25 bp, Mus musculus
tttacttcagtggttactttcctca

SEQ ID NO: 964355 - DNA, 25 bp, Mus musculus
tttacttcatcacggaactgtctcc

SEQ ID NO: 964356 - DNA, 25 bp, Mus musculus
tttacttcatcagggaactgtctcc

SEQ ID NO: 964357 - DNA, 25 bp, Mus musculus
tttacttcatgacatctttgctgga

SEQ ID NO: 964358 - DNA, 25 bp, Mus musculus
tttacttcatgagatctttgctgga

SEQ ID NO: 964359 - DNA, 25 bp, Mus musculus
tttacttcattaaccacatagtggg

SEQ ID NO: 964360 - DNA, 25 bp, Mus musculus
tttacttcattaattcctgtttggg

SEQ ID NO: 964361 - DNA, 25 bp, Mus musculus
tttacttcattatccacatagtggg

SEQ ID NO: 964362 - DNA, 25 bp, Mus musculus
tttacttcattatttcctgtttggg

SEQ ID NO: 964363 - DNA, 25 bp, Mus musculus
tttacttcattcacctctatctcac

SEQ ID NO: 964364 - DNA, 25 bp, Mus musculus
tttacttcattctcctctatctcac

SEQ ID NO: 964365 - DNA, 25 bp, Mus musculus
tttacttccccaacaagcttgaaca

SEQ ID NO: 964366 - DNA, 25 bp, Mus musculus
tttacttccccatcaagcttgaaca

SEQ ID NO: 964367 - DNA, 25 bp, Mus musculus
tttacttccctgctgtttatttgct

SEQ ID NO: 964368 - DNA, 25 bp, Mus musculus
tttacttccctggtgtttatttgct

SEQ ID NO: 964369 - DNA, 25 bp, Mus musculus
tttacttcccttcatttgttgctgc

SEQ ID NO: 964370 - DNA, 25 bp, Mus musculus
tttacttcccttgatttgttgctgc

SEQ ID NO: 964371 - DNA, 25 bp, Mus musculus
tttacttcctataatgtcacatcgt

SEQ ID NO: 964372 - DNA, 25 bp, Mus musculus
tttacttcctattatgtcacatcgt

SEQ ID NO: 964373 - DNA, 25 bp, Mus musculus
tttacttccttccttggtatggatg

SEQ ID NO: 964374 - DNA, 25 bp, Mus musculus
tttacttccttcgttggtatggatg

SEQ ID NO: 964375 - DNA, 25 bp, Mus musculus
tttacttcgagtacagagcctgaaa

SEQ ID NO: 964376 - DNA, 25 bp, Mus musculus
tttacttcgagttcagagcctgaaa

SEQ ID NO: 964377 - DNA, 25 bp, Mus musculus
tttacttctaagatgggatctccct

SEQ ID NO: 964378 - DNA, 25 bp, Mus musculus
tttacttctaagttgggatctccct

SEQ ID NO: 964379 - DNA, 25 bp, Mus musculus
tttacttctctaactatgacaattg

SEQ ID NO: 964380 - DNA, 25 bp, Mus musculus
tttacttctctatctatgacaattg

SEQ ID NO: 964381 - DNA, 25 bp, Mus musculus
tttacttctcttactagcaagaaga

SEQ ID NO: 964382 - DNA, 25 bp, Mus musculus
tttacttctctttctagcaagaaga

SEQ ID NO: 964383 - DNA, 25 bp, Mus musculus
tttacttctgcgatttggtgaacac

SEQ ID NO: 964384 - DNA, 25 bp, Mus musculus
tttacttctgcgttttggtgaacac

SEQ ID NO: 964385 - DNA, 25 bp, Mus musculus
tttacttcttacctgttggctttca

SEQ ID NO: 964386 - DNA, 25 bp, Mus musculus
tttacttcttacgtgttggctttca

SEQ ID NO: 964387 - DNA, 25 bp, Mus musculus
tttacttcttctcttgcatatgcca

SEQ ID NO: 964388 - DNA, 25 bp, Mus musculus
tttacttcttctgttgcatatgcca

SEQ ID NO: 964389 - DNA, 25 bp, Mus musculus
tttacttgaaaacctcggcagaata

SEQ ID NO: 964390 - DNA, 25 bp, Mus musculus
tttacttgaaaagctcggcagaata

SEQ ID NO: 964391 - DNA, 25 bp, Mus musculus
tttacttgaaataatgtcactagac

SEQ ID NO: 964392 - DNA, 25 bp, Mus musculus
tttacttgaaattatgtcactagac

SEQ ID NO: 964393 - DNA, 25 bp, Mus musculus
tttacttgaagcacggacataccac

SEQ ID NO: 964394 - DNA, 25 bp, Mus musculus
tttacttgaagctcggacataccac

SEQ ID NO: 964395 - DNA, 25 bp, Mus musculus
tttacttgacaaacctaattttcca

SEQ ID NO: 964396 - DNA, 25 bp, Mus musculus
tttacttgacaatcctaattttcca

SEQ ID NO: 964397 - DNA, 25 bp, Mus musculus
tttacttgatcgaagacaccaccca

SEQ ID NO: 964398 - DNA, 25 bp, Mus musculus
tttacttgatcgtagacaccaccca

SEQ ID NO: 964399 - DNA, 25 bp, Mus musculus
tttacttgccagactcctgtgtaaa

SEQ ID NO: 964400 - DNA, 25 bp, Mus musculus
tttacttgccagtctcctgtgtaaa

SEQ ID NO: 964401 - DNA, 25 bp, Mus musculus
tttacttgctcactcttcaaatagt

SEQ ID NO: 964402 - DNA, 25 bp, Mus musculus
tttacttgctcagtcttcaaatagt

SEQ ID NO: 964403 - DNA, 25 bp, Mus musculus
tttacttgggtcatacttcatgcag

SEQ ID NO: 964404 - DNA, 25 bp, Mus musculus
tttacttgggtcttacttcatgcag

SEQ ID NO: 964405 - DNA, 25 bp, Mus musculus
tttacttgtatcatcttgtccttca

SEQ ID NO: 964406 - DNA, 25 bp, Mus musculus
tttacttgtatcttcttgtccttca

SEQ ID NO: 964407 - DNA, 25 bp, Mus musculus
tttacttgtatgagcaccctccgat

SEQ ID NO: 964408 - DNA, 25 bp, Mus musculus
tttacttgtatgcacatgcctaccc

SEQ ID NO: 964409 - DNA, 25 bp, Mus musculus
tttacttgtatgcttttggccaaca

SEQ ID NO: 964410 - DNA, 25 bp, Mus musculus
tttacttgtatggacatgcctaccc

SEQ ID NO: 964411 - DNA, 25 bp, Mus musculus
tttacttgtatggttttggccaaca

SEQ ID NO: 964412 - DNA, 25 bp, Mus musculus
tttacttgtatgtgcaccctccgat

SEQ ID NO: 964413 - DNA, 25 bp, Mus musculus
tttacttgtgatccttcaggtttca

SEQ ID NO: 964414 - DNA, 25 bp, Mus musculus
tttacttgtgatgcttcaggtttca

SEQ ID NO: 964415 - DNA, 25 bp, Mus musculus
tttactttcgaaactgtccccaaga

SEQ ID NO: 964416 - DNA, 25 bp, Mus musculus
tttactttcgaatctgtccccaaga

SEQ ID NO: 964417 - DNA, 25 bp, Mus musculus
tttactttctctcacgctaccttct

SEQ ID NO: 964418 - DNA, 25 bp, Mus musculus
tttactttctctgacgctaccttct

SEQ ID NO: 964419 - DNA, 25 bp, Mus musculus
tttactttctggcagatgggcattt

SEQ ID NO: 964420 - DNA, 25 bp, Mus musculus
tttactttctgggagatgggcattt

SEQ ID NO: 964421 - DNA, 25 bp, Mus musculus
tttactttgcccatctcttggataa

SEQ ID NO: 964422 - DNA, 25 bp, Mus musculus
tttactttgcccttctcttggataa

SEQ ID NO: 964423 - DNA, 25 bp, Mus musculus
tttactttgtttactcaagtgctgt

SEQ ID NO: 964424 - DNA, 25 bp, Mus musculus
tttactttgtttaggcactggactg

SEQ ID NO: 964425 - DNA, 25 bp, Mus musculus
tttactttgttttctcaagtgctgt

SEQ ID NO: 964426 - DNA, 25 bp, Mus musculus
tttactttgttttggcactggactg

SEQ ID NO: 964427 - DNA, 25 bp, Mus musculus
tttacttttcaacccagacaagcaa

SEQ ID NO: 964428 - DNA, 25 bp, Mus musculus
tttacttttcaagccagacaagcaa

SEQ ID NO: 964429 - DNA, 25 bp, Mus musculus
tttacttttcatatctgggactcaa

SEQ ID NO: 964430 - DNA, 25 bp, Mus musculus
tttacttttcatttctgggactcaa

SEQ ID NO: 964431 - DNA, 25 bp, Mus musculus
tttacttttcttcagggtagcatgt

SEQ ID NO: 964432 - DNA, 25 bp, Mus musculus
tttacttttcttgagggtagcatgt

SEQ ID NO: 964433 - DNA, 25 bp, Mus musculus
tttagaaacgaacccgccaatttat

SEQ ID NO: 964434 - DNA, 25 bp, Mus musculus
tttagaaacgaagccgccaatttat

SEQ ID NO: 964435 - DNA, 25 bp, Mus musculus
tttagaaagaatacctccatttgga

SEQ ID NO: 964436 - DNA, 25 bp, Mus musculus
tttagaaagaattcctccatttgga

SEQ ID NO: 964437 - DNA, 25 bp, Mus musculus
tttagaaagactactgctcgcctgc

SEQ ID NO: 964438 - DNA, 25 bp, Mus musculus
tttagaaagactccacacagcaaaa

SEQ ID NO: 964439 - DNA, 25 bp, Mus musculus
tttagaaagactgcacacagcaaaa

SEQ ID NO: 964440 - DNA, 25 bp, Mus musculus
tttagaaagacttctgctcgcctgc

SEQ ID NO: 964441 - DNA, 25 bp, Mus musculus
tttagaaagtccagctgggccgggc

SEQ ID NO: 964442 - DNA, 25 bp, Mus musculus
tttagaaagtcctgctgggccgggc

SEQ ID NO: 964443 - DNA, 25 bp, Mus musculus
tttagaaatcacacattctcctcct

SEQ ID NO: 964444 - DNA, 25 bp, Mus musculus
tttagaaatcactcattctcctcct

SEQ ID NO: 964445 - DNA, 25 bp, Mus musculus
tttagaacactgaaaacaaactgtg

SEQ ID NO: 964446 - DNA, 25 bp, Mus musculus
tttagaacactgtaaacaaactgtg

SEQ ID NO: 964447 - DNA, 25 bp, Mus musculus
tttagaaccgctaaggagaaccctg

SEQ ID NO: 964448 - DNA, 25 bp, Mus musculus
tttagaaccgcttaggagaaccctg

SEQ ID NO: 964449 - DNA, 25 bp, Mus musculus
tttagaactaccattatctcccact

SEQ ID NO: 964450 - DNA, 25 bp, Mus musculus
tttagaactacctttatctcccact

SEQ ID NO: 964451 - DNA, 25 bp, Mus musculus
tttagaagccaccttcctaacttgc

SEQ ID NO: 964452 - DNA, 25 bp, Mus musculus
tttagaagccacgttcctaacttgc

SEQ ID NO: 964453 - DNA, 25 bp, Mus musculus
tttagaagctatcgccaccctaggg

SEQ ID NO: 964454 - DNA, 25 bp, Mus musculus
tttagaagctatggccaccctaggg

SEQ ID NO: 964455 - DNA, 25 bp, Mus musculus
tttagaagcttactctgttctccac

SEQ ID NO: 964456 - DNA, 25 bp, Mus musculus
tttagaagcttagtctgttctccac

SEQ ID NO: 964457 - DNA, 25 bp, Mus musculus
tttagaagggctcatgtgttcatag

SEQ ID NO: 964458 - DNA, 25 bp, Mus musculus
tttagaagggctgatgtgttcatag

SEQ ID NO: 964459 - DNA, 25 bp, Mus musculus
tttagaagtgcccatgtgtgactgt

SEQ ID NO: 964460 - DNA, 25 bp, Mus musculus
tttagaagtgccgatgtgtgactgt

SEQ ID NO: 964461 - DNA, 25 bp, Mus musculus
tttagaatacccagtcctacctcat

SEQ ID NO: 964462 - DNA, 25 bp, Mus musculus
tttagaataccctgtcctacctcat

SEQ ID NO: 964463 - DNA, 25 bp, Mus musculus
tttagaatacttcgactgcctagct

SEQ ID NO: 964464 - DNA, 25 bp, Mus musculus
tttagaatacttggactgcctagct

SEQ ID NO: 964465 - DNA, 25 bp, Mus musculus
tttagaatagctccgcctcctcgtc

SEQ ID NO: 964466 - DNA, 25 bp, Mus musculus
tttagaatagctgcgcctcctcgtc

SEQ ID NO: 964467 - DNA, 25 bp, Mus musculus
tttagaatattccttctccctggga

SEQ ID NO: 964468 - DNA, 25 bp, Mus musculus
tttagaatattcgttctccctggga

SEQ ID NO: 964469 - DNA, 25 bp, Mus musculus
tttagaatcaggatcttgactggag

SEQ ID NO: 964470 - DNA, 25 bp, Mus musculus
tttagaatcaggttcttgactggag

SEQ ID NO: 964471 - DNA, 25 bp, Mus musculus
tttagaatcatacctcttggcatgt

SEQ ID NO: 964472 - DNA, 25 bp, Mus musculus
tttagaatcatagctcttggcatgt

SEQ ID NO: 964473 - DNA, 25 bp, Mus musculus
tttagaattccaccacagactgaag

SEQ ID NO: 964474 - DNA, 25 bp, Mus musculus
tttagaattccagcacagactgaag

SEQ ID NO: 964475 - DNA, 25 bp, Mus musculus
tttagaattctgacatgtatttgtt

SEQ ID NO: 964476 - DNA, 25 bp, Mus musculus
tttagaattctgcacgctgtctccc

SEQ ID NO: 964477 - DNA, 25 bp, Mus musculus
tttagaattctggacgctgtctccc

SEQ ID NO: 964478 - DNA, 25 bp, Mus musculus
tttagaattctgtcatgtatttgtt

SEQ ID NO: 964479 - DNA, 25 bp, Mus musculus
tttagaattttccagccccattatc

SEQ ID NO: 964480 - DNA, 25 bp, Mus musculus
tttagaattttcgagccccattatc

SEQ ID NO: 964481 - DNA, 25 bp, Mus musculus
tttagacaacagcatgtccgggaga

SEQ ID NO: 964482 - DNA, 25 bp, Mus musculus
tttagacaacaggatgtccgggaga

SEQ ID NO: 964483 - DNA, 25 bp, Mus musculus
tttagacaccaaacaaattgctggg

SEQ ID NO: 964484 - DNA, 25 bp, Mus musculus
tttagacaccaatcaaattgctggg

SEQ ID NO: 964485 - DNA, 25 bp, Mus musculus
tttagacacggacgcctttctgtaa

SEQ ID NO: 964486 - DNA, 25 bp, Mus musculus
tttagacacggaggcctttctgtaa

SEQ ID NO: 964487 - DNA, 25 bp, Mus musculus
tttagacacgtcacaccagcgggta

SEQ ID NO: 964488 - DNA, 25 bp, Mus musculus
tttagacacgtctcaccagcgggta

SEQ ID NO: 964489 - DNA, 25 bp, Mus musculus
tttagacagcttaattcttaagtgc

SEQ ID NO: 964490 - DNA, 25 bp, Mus musculus
tttagacagctttattcttaagtgc

SEQ ID NO: 964491 - DNA, 25 bp, Mus musculus
tttagacagggacagggtcttgctt

SEQ ID NO: 964492 - DNA, 25 bp, Mus musculus
tttagacagggagagggtcttgctt

SEQ ID NO: 964493 - DNA, 25 bp, Mus musculus
tttagacagggcactgtcagctttc

SEQ ID NO: 964494 - DNA, 25 bp, Mus musculus
tttagacagggctctgtcagctttc

SEQ ID NO: 964495 - DNA, 25 bp, Mus musculus
tttagacaggttactcatgctccca

SEQ ID NO: 964496 - DNA, 25 bp, Mus musculus
tttagacaggtttctcatgctccca

SEQ ID NO: 964497 - DNA, 25 bp, Mus musculus
tttagacagtccataagtttccaga

SEQ ID NO: 964498 - DNA, 25 bp, Mus musculus
tttagacagtccttaagtttccaga

SEQ ID NO: 964499 - DNA, 25 bp, Mus musculus
tttagacagtttactctttgtttca

SEQ ID NO: 964500 - DNA, 25 bp, Mus musculus
tttagacagttttctctttgtttca

SEQ ID NO: 964501 - DNA, 25 bp, Mus musculus
tttagacatccccaaagcaagcctc

SEQ ID NO: 964502 - DNA, 25 bp, Mus musculus
tttagacatcccgaaagcaagcctc

SEQ ID NO: 964503 - DNA, 25 bp, Mus musculus
tttagacatgagaggcaatgcaagc

SEQ ID NO: 964504 - DNA, 25 bp, Mus musculus
tttagacatgagtggcaatgcaagc

SEQ ID NO: 964505 - DNA, 25 bp, Mus musculus
tttagaccagtcattggccagctca

SEQ ID NO: 964506 - DNA, 25 bp, Mus musculus
tttagaccagtctttggccagctca

SEQ ID NO: 964507 - DNA, 25 bp, Mus musculus
tttagaccatctaaggatacacagt

SEQ ID NO: 964508 - DNA, 25 bp, Mus musculus
tttagaccatcttaggatacacagt

SEQ ID NO: 964509 - DNA, 25 bp, Mus musculus
tttagacccgaacgctggcttgaaa

SEQ ID NO: 964510 - DNA, 25 bp, Mus musculus
tttagacccgaaggctggcttgaaa

SEQ ID NO: 964511 - DNA, 25 bp, Mus musculus
tttagaccttacatttcattcacac

SEQ ID NO: 964512 - DNA, 25 bp, Mus musculus
tttagaccttacttttcattcacac

SEQ ID NO: 964513 - DNA, 25 bp, Mus musculus
tttagacgcaaaagcagcgcacccc

SEQ ID NO: 964514 - DNA, 25 bp, Mus musculus
tttagacgcaaatgcagcgcacccc

SEQ ID NO: 964515 - DNA, 25 bp, Mus musculus
tttagacgtcttagttttgacacac

SEQ ID NO: 964516 - DNA, 25 bp, Mus musculus
tttagacgtctttgttttgacacac

SEQ ID NO: 964517 - DNA, 25 bp, Mus musculus
tttagacgtgaaagtctcagcaagg

SEQ ID NO: 964518 - DNA, 25 bp, Mus musculus
tttagacgtgaatgtctcagcaagg

SEQ ID NO: 964519 - DNA, 25 bp, Mus musculus
tttagactatggcctcagacccaag

SEQ ID NO: 964520 - DNA, 25 bp, Mus musculus
tttagactatgggctcagacccaag

SEQ ID NO: 964521 - DNA, 25 bp, Mus musculus
tttagactccgaaagcagtggcttg

SEQ ID NO: 964522 - DNA, 25 bp, Mus musculus
tttagactccgatagcagtggcttg

SEQ ID NO: 964523 - DNA, 25 bp, Mus musculus
tttagactctgtatttcgtttttga

SEQ ID NO: 964524 - DNA, 25 bp, Mus musculus
tttagactctgtttttcgtttttga

SEQ ID NO: 964525 - DNA, 25 bp, Mus musculus
tttagactgtggcatctcccatctt

SEQ ID NO: 964526 - DNA, 25 bp, Mus musculus
tttagactgtgggatctcccatctt

SEQ ID NO: 964527 - DNA, 25 bp, Mus musculus
tttagacttaaacattacagtccct

SEQ ID NO: 964528 - DNA, 25 bp, Mus musculus
tttagacttaaagattacagtccct

SEQ ID NO: 964529 - DNA, 25 bp, Mus musculus
tttagacttagtaatcttccactca

SEQ ID NO: 964530 - DNA, 25 bp, Mus musculus
tttagacttagttatcttccactca

SEQ ID NO: 964531 - DNA, 25 bp, Mus musculus
tttagacttccaatcaggaggaagc

SEQ ID NO: 964532 - DNA, 25 bp, Mus musculus
tttagacttccattcaggaggaagc

SEQ ID NO: 964533 - DNA, 25 bp, Mus musculus
tttagagaatgtaagccgtgcctcc

SEQ ID NO: 964534 - DNA, 25 bp, Mus musculus
tttagagaatgttagccgtgcctcc

SEQ ID NO: 964535 - DNA, 25 bp, Mus musculus
tttagagaccatcctgtgggctgca

SEQ ID NO: 964536 - DNA, 25 bp, Mus musculus
tttagagaccatgctgtgggctgca

SEQ ID NO: 964537 - DNA, 25 bp, Mus musculus
tttagagacctcaccagcagtaatg

SEQ ID NO: 964538 - DNA, 25 bp, Mus musculus
tttagagacctctccagcagtaatg

SEQ ID NO: 964539 - DNA, 25 bp, Mus musculus
tttagagactccatgctgtgtgtaa

SEQ ID NO: 964540 - DNA, 25 bp, Mus musculus
tttagagactccttgctgtgtgtaa

SEQ ID NO: 964541 - DNA, 25 bp, Mus musculus
tttagagagcttacagtgatgctgt

SEQ ID NO: 964542 - DNA, 25 bp, Mus musculus
tttagagagcttagcccctttacag

SEQ ID NO: 964543 - DNA, 25 bp, Mus musculus
tttagagagctttcagtgatgctgt

SEQ ID NO: 964544 - DNA, 25 bp, Mus musculus
tttagagagctttgcccctttacag

SEQ ID NO: 964545 - DNA, 25 bp, Mus musculus
tttagagagtggatcctccatgcca

SEQ ID NO: 964546 - DNA, 25 bp, Mus musculus
tttagagagtggttcctccatgcca

SEQ ID NO: 964547 - DNA, 25 bp, Mus musculus
tttagagatctgaccctgcagaccg

SEQ ID NO: 964548 - DNA, 25 bp, Mus musculus
tttagagatctgtccctgcagaccg

SEQ ID NO: 964549 - DNA, 25 bp, Mus musculus
tttagagcaacaaacgcccgacatg

SEQ ID NO: 964550 - DNA, 25 bp, Mus musculus
tttagagcaacatacgcccgacatg

SEQ ID NO: 964551 - DNA, 25 bp, Mus musculus
tttagagcaagcatgttgtttttaa

SEQ ID NO: 964552 - DNA, 25 bp, Mus musculus
tttagagcaagcttgttgtttttaa

SEQ ID NO: 964553 - DNA, 25 bp, Mus musculus
tttagagccatcaagcatcgaggtg

SEQ ID NO: 964554 - DNA, 25 bp, Mus musculus
tttagagccatctagcatcgaggtg

SEQ ID NO: 964555 - DNA, 25 bp, Mus musculus
tttagagcccctcttgtttgacctt

SEQ ID NO: 964556 - DNA, 25 bp, Mus musculus
tttagagcccctgttgtttgacctt

SEQ ID NO: 964557 - DNA, 25 bp, Mus musculus
tttagagccctactctgcctgcagt

SEQ ID NO: 964558 - DNA, 25 bp, Mus musculus
tttagagccctagtctgcctgcagt

SEQ ID NO: 964559 - DNA, 25 bp, Mus musculus
tttagagctcctattgtatgtctgt

SEQ ID NO: 964560 - DNA, 25 bp, Mus musculus
tttagagctccttttgtatgtctgt

SEQ ID NO: 964561 - DNA, 25 bp, Mus musculus
tttagagctttccttttgcggctaa

SEQ ID NO: 964562 - DNA, 25 bp, Mus musculus
tttagagctttcgttttgcggctaa

SEQ ID NO: 964563 - DNA, 25 bp, Mus musculus
tttagaggctggctctcttctcagg

SEQ ID NO: 964564 - DNA, 25 bp, Mus musculus
tttagaggctgggtctcttctcagg

SEQ ID NO: 964565 - DNA, 25 bp, Mus musculus
tttagaggcttgctggacagtaact

SEQ ID NO: 964566 - DNA, 25 bp, Mus musculus
tttagaggcttggtggacagtaact

SEQ ID NO: 964567 - DNA, 25 bp, Mus musculus
tttagagggcacaaagcctcgctga

SEQ ID NO: 964568 - DNA, 25 bp, Mus musculus
tttagagggcactaagcctcgctga

SEQ ID NO: 964569 - DNA, 25 bp, Mus musculus
tttagaggtagaccccaggtccatc

SEQ ID NO: 964570 - DNA, 25 bp, Mus musculus
tttagaggtagagcccaggtccatc

SEQ ID NO: 964571 - DNA, 25 bp, Mus musculus
tttagaggtctcatcctgtgaaata

SEQ ID NO: 964572 - DNA, 25 bp, Mus musculus
tttagaggtctcttcctgtgaaata

SEQ ID NO: 964573 - DNA, 25 bp, Mus musculus
tttagaggtgatatagaccggcaca

SEQ ID NO: 964574 - DNA, 25 bp, Mus musculus
tttagaggtgatttagaccggcaca

SEQ ID NO: 964575 - DNA, 25 bp, Mus musculus
tttagaggttgccacatgttccctg

SEQ ID NO: 964576 - DNA, 25 bp, Mus musculus
tttagaggttgcgacatgttccctg

SEQ ID NO: 964577 - DNA, 25 bp, Mus musculus
tttagagtaagcagaggcccacagt

SEQ ID NO: 964578 - DNA, 25 bp, Mus musculus
tttagagtaagctgaggcccacagt

SEQ ID NO: 964579 - DNA, 25 bp, Mus musculus
tttagagtacccatgcagtcctttg

SEQ ID NO: 964580 - DNA, 25 bp, Mus musculus
tttagagtacccttgcagtcctttg

SEQ ID NO: 964581 - DNA, 25 bp, Mus musculus
tttagagtaccgaaccccattctca

SEQ ID NO: 964582 - DNA, 25 bp, Mus musculus
tttagagtaccgtaccccattctca

SEQ ID NO: 964583 - DNA, 25 bp, Mus musculus
tttagagtacttcgtcttagaccag

SEQ ID NO: 964584 - DNA, 25 bp, Mus musculus
tttagagtacttggtcttagaccag

SEQ ID NO: 964585 - DNA, 25 bp, Mus musculus
tttagagtcactagcccttcacttt

SEQ ID NO: 964586 - DNA, 25 bp, Mus musculus
tttagagtcacttgcccttcacttt

SEQ ID NO: 964587 - DNA, 25 bp, Mus musculus
tttagagtccaacccgtgccactaa

SEQ ID NO: 964588 - DNA, 25 bp, Mus musculus
tttagagtccaagccgtgccactaa

SEQ ID NO: 964589 - DNA, 25 bp, Mus musculus
tttagagtgcttactcatttttctg

SEQ ID NO: 964590 - DNA, 25 bp, Mus musculus
tttagagtgctttctcatttttctg

SEQ ID NO: 964591 - DNA, 25 bp, Mus musculus
tttagagtggagaacacttcccctc

SEQ ID NO: 964592 - DNA, 25 bp, Mus musculus
tttagagtggagtacacttcccctc

SEQ ID NO: 964593 - DNA, 25 bp, Mus musculus
tttagataacacacgcagaagagcc

SEQ ID NO: 964594 - DNA, 25 bp, Mus musculus
tttagataacactcgcagaagagcc

SEQ ID NO: 964595 - DNA, 25 bp, Mus musculus
tttagataccacagttcccttgagg

SEQ ID NO: 964596 - DNA, 25 bp, Mus musculus
tttagataccactgttcccttgagg

SEQ ID NO: 964597 - DNA, 25 bp, Mus musculus
tttagatagggcaccactctgtagc

SEQ ID NO: 964598 - DNA, 25 bp, Mus musculus
tttagatagggctccactctgtagc

SEQ ID NO: 964599 - DNA, 25 bp, Mus musculus
tttagatcactaacatgccatgctc

SEQ ID NO: 964600 - DNA, 25 bp, Mus musculus
tttagatcactatcatgccatgctc

SEQ ID NO: 964601 - DNA, 25 bp, Mus musculus
tttagatcattgaaagaccctggtg

SEQ ID NO: 964602 - DNA, 25 bp, Mus musculus
tttagatcattgtaagaccctggtg

SEQ ID NO: 964603 - DNA, 25 bp, Mus musculus
tttagatcgttcacgcagatacctc

SEQ ID NO: 964604 - DNA, 25 bp, Mus musculus
tttagatcgttctcgcagatacctc

SEQ ID NO: 964605 - DNA, 25 bp, Mus musculus
tttagatcttttatacatggcatgt

SEQ ID NO: 964606 - DNA, 25 bp, Mus musculus
tttagatcttttttacatggcatgt

SEQ ID NO: 964607 - DNA, 25 bp, Mus musculus
tttagatgaccaagccttcacactg

SEQ ID NO: 964608 - DNA, 25 bp, Mus musculus
tttagatgaccatgccttcacactg

SEQ ID NO: 964609 - DNA, 25 bp, Mus musculus
tttagatgagtcatgctcttgagcc

SEQ ID NO: 964610 - DNA, 25 bp, Mus musculus
tttagatgagtcttgctcttgagcc

SEQ ID NO: 964611 - DNA, 25 bp, Mus musculus
tttagatgcaataccccaaacttcc

SEQ ID NO: 964612 - DNA, 25 bp, Mus musculus
tttagatgcaattccccaaacttcc

SEQ ID NO: 964613 - DNA, 25 bp, Mus musculus
tttagatggcccatgtaagctgtgg

SEQ ID NO: 964614 - DNA, 25 bp, Mus musculus
tttagatggcccttgtaagctgtgg

SEQ ID NO: 964615 - DNA, 25 bp, Mus musculus
tttagatgtgctctaccaccaggag

SEQ ID NO: 964616 - DNA, 25 bp, Mus musculus
tttagatgtgctgtaccaccaggag

SEQ ID NO: 964617 - DNA, 25 bp, Mus musculus
tttagatgtttcagtttgctaatcc

SEQ ID NO: 964618 - DNA, 25 bp, Mus musculus
tttagatgtttctgtttgctaatcc

SEQ ID NO: 964619 - DNA, 25 bp, Mus musculus
tttagattccacactctacttcagc

SEQ ID NO: 964620 - DNA, 25 bp, Mus musculus
tttagattccactctctacttcagc

SEQ ID NO: 964621 - DNA, 25 bp, Mus musculus
tttagattggtccacacacctcaga

SEQ ID NO: 964622 - DNA, 25 bp, Mus musculus
tttagattggtcgacacacctcaga

SEQ ID NO: 964623 - DNA, 25 bp, Mus musculus
tttagatttggaaggcatttttcac

SEQ ID NO: 964624 - DNA, 25 bp, Mus musculus
tttagatttggatggcatttttcac

SEQ ID NO: 964625 - DNA, 25 bp, Mus musculus
tttagatttgtgcttctccttttgg

SEQ ID NO: 964626 - DNA, 25 bp, Mus musculus
tttagatttgtggttctccttttgg

SEQ ID NO: 964627 - DNA, 25 bp, Mus musculus
tttagatttttccacgtccagccta

SEQ ID NO: 964628 - DNA, 25 bp, Mus musculus
tttagatttttcgacgtccagccta

SEQ ID NO: 964629 - DNA, 25 bp, Mus musculus
tttagcaagacccttcctggacact

SEQ ID NO: 964630 - DNA, 25 bp, Mus musculus
tttagcaagaccgttcctggacact

SEQ ID NO: 964631 - DNA, 25 bp, Mus musculus
tttagcaaggcccagggcctcacag

SEQ ID NO: 964632 - DNA, 25 bp, Mus musculus
tttagcaaggccgagggcctcacag

SEQ ID NO: 964633 - DNA, 25 bp, Mus musculus
tttagcaatttgcagttagtgggtt

SEQ ID NO: 964634 - DNA, 25 bp, Mus musculus
tttagcaatttggagttagtgggtt

SEQ ID NO: 964635 - DNA, 25 bp, Mus musculus
tttagcacaattcttgcttttagat

SEQ ID NO: 964636 - DNA, 25 bp, Mus musculus
tttagcacaattgttgcttttagat

SEQ ID NO: 964637 - DNA, 25 bp, Mus musculus
tttagcaccgtcaagcccatgtacg

SEQ ID NO: 964638 - DNA, 25 bp, Mus musculus
tttagcaccgtctagcccatgtacg

SEQ ID NO: 964639 - DNA, 25 bp, Mus musculus
tttagcacggttccggctctggagt

SEQ ID NO: 964640 - DNA, 25 bp, Mus musculus
tttagcacggttgcggctctggagt

SEQ ID NO: 964641 - DNA, 25 bp, Mus musculus
tttagcactaccatccaggctgctg

SEQ ID NO: 964642 - DNA, 25 bp, Mus musculus
tttagcactaccttccaggctgctg

SEQ ID NO: 964643 - DNA, 25 bp, Mus musculus
tttagcactatcaggtggcccgcaa

SEQ ID NO: 964644 - DNA, 25 bp, Mus musculus
tttagcactatctggtggcccgcaa

SEQ ID NO: 964645 - DNA, 25 bp, Mus musculus
tttagcactcatatcaactgtcata

SEQ ID NO: 964646 - DNA, 25 bp, Mus musculus
tttagcactcatttcaactgtcata

SEQ ID NO: 964647 - DNA, 25 bp, Mus musculus
tttagcactgagcagcaccctcagg

SEQ ID NO: 964648 - DNA, 25 bp, Mus musculus
tttagcactgaggagcaccctcagg

SEQ ID NO: 964649 - DNA, 25 bp, Mus musculus
tttagcactttaactgacaatgatg

SEQ ID NO: 964650 - DNA, 25 bp, Mus musculus
tttagcactttatctgacaatgatg

SEQ ID NO: 964651 - DNA, 25 bp, Mus musculus
tttagcagaagtcagtattccagcc

SEQ ID NO: 964652 - DNA, 25 bp, Mus musculus
tttagcagaagtgagtattccagcc

SEQ ID NO: 964653 - DNA, 25 bp, Mus musculus
tttagcagacctcaataaatctcct

SEQ ID NO: 964654 - DNA, 25 bp, Mus musculus
tttagcagacctgaataaatctcct

SEQ ID NO: 964655 - DNA, 25 bp, Mus musculus
tttagcagccagctttaccaatctg

SEQ ID NO: 964656 - DNA, 25 bp, Mus musculus
tttagcagccaggtttaccaatctg

SEQ ID NO: 964657 - DNA, 25 bp, Mus musculus
tttagcaggattacctcctccaaaa

SEQ ID NO: 964658 - DNA, 25 bp, Mus musculus
tttagcaggatttcctcctccaaaa

SEQ ID NO: 964659 - DNA, 25 bp, Mus musculus
tttagcataatcaagatgactattt

SEQ ID NO: 964660 - DNA, 25 bp, Mus musculus
tttagcataatctagatgactattt

SEQ ID NO: 964661 - DNA, 25 bp, Mus musculus
tttagcatactcaacagaccatagt

SEQ ID NO: 964662 - DNA, 25 bp, Mus musculus
tttagcatactctacagaccatagt

SEQ ID NO: 964663 - DNA, 25 bp, Mus musculus
tttagcatatttacgtccctgtcag

SEQ ID NO: 964664 - DNA, 25 bp, Mus musculus
tttagcatattttcgtccctgtcag

SEQ ID NO: 964665 - DNA, 25 bp, Mus musculus
tttagcatcaaaaaaccacctgtat

SEQ ID NO: 964666 - DNA, 25 bp, Mus musculus
tttagcatcaaataaccacctgtat

SEQ ID NO: 964667 - DNA, 25 bp, Mus musculus
tttagcatgcaacccaggaaaagtg

SEQ ID NO: 964668 - DNA, 25 bp, Mus musculus
tttagcatgcaagccaggaaaagtg

SEQ ID NO: 964669 - DNA, 25 bp, Mus musculus
tttagcatgggacttctgggagcct

SEQ ID NO: 964670 - DNA, 25 bp, Mus musculus
tttagcatgggagttctgggagcct

SEQ ID NO: 964671 - DNA, 25 bp, Mus musculus
tttagcattgatatgaaccatggac

SEQ ID NO: 964672 - DNA, 25 bp, Mus musculus
tttagcattgatttgaaccatggac

SEQ ID NO: 964673 - DNA, 25 bp, Mus musculus
tttagccaagtgcagctgtagttga

SEQ ID NO: 964674 - DNA, 25 bp, Mus musculus
tttagccaagtggagctgtagttga

SEQ ID NO: 964675 - DNA, 25 bp, Mus musculus
tttagccaccctcgattttgcacag

SEQ ID NO: 964676 - DNA, 25 bp, Mus musculus
tttagccaccctggattttgcacag

SEQ ID NO: 964677 - DNA, 25 bp, Mus musculus
tttagccacctaacatccagtgatg

SEQ ID NO: 964678 - DNA, 25 bp, Mus musculus
tttagccacctatcatccagtgatg

SEQ ID NO: 964679 - DNA, 25 bp, Mus musculus
tttagccagactcagtatgtgggtc

SEQ ID NO: 964680 - DNA, 25 bp, Mus musculus
tttagccagactgagtatgtgggtc

SEQ ID NO: 964681 - DNA, 25 bp, Mus musculus
tttagccagcctatttacttattct

SEQ ID NO: 964682 - DNA, 25 bp, Mus musculus
tttagccagcctttttacttattct

SEQ ID NO: 964683 - DNA, 25 bp, Mus musculus
tttagccatcttctgctcttggtaa

SEQ ID NO: 964684 - DNA, 25 bp, Mus musculus
tttagccatcttgtgctcttggtaa

SEQ ID NO: 964685 - DNA, 25 bp, Mus musculus
tttagccattttagttctgaacagt

SEQ ID NO: 964686 - DNA, 25 bp, Mus musculus
tttagccatttttgttctgaacagt

SEQ ID NO: 964687 - DNA, 25 bp, Mus musculus
tttagcccacagaacccctgggtga

SEQ ID NO: 964688 - DNA, 25 bp, Mus musculus
tttagcccacagtacccctgggtga

SEQ ID NO: 964689 - DNA, 25 bp, Mus musculus
tttagcccaggcattgccagatgga

SEQ ID NO: 964690 - DNA, 25 bp, Mus musculus
tttagcccaggctttgccagatgga

SEQ ID NO: 964691 - DNA, 25 bp, Mus musculus
tttagccccctgcaacagagttgtt

SEQ ID NO: 964692 - DNA, 25 bp, Mus musculus
tttagccccctggaacagagttgtt

SEQ ID NO: 964693 - DNA, 25 bp, Mus musculus
tttagccctcacaccaagcaaggcg

SEQ ID NO: 964694 - DNA, 25 bp, Mus musculus
tttagccctcactccaagcaaggcg

SEQ ID NO: 964695 - DNA, 25 bp, Mus musculus
tttagccctccaaaaagaaggatag

SEQ ID NO: 964696 - DNA, 25 bp, Mus musculus
tttagccctccataaagaaggatag

SEQ ID NO: 964697 - DNA, 25 bp, Mus musculus
tttagccctggcagctttataccct

SEQ ID NO: 964698 - DNA, 25 bp, Mus musculus
tttagccctggctgctttataccct

SEQ ID NO: 964699 - DNA, 25 bp, Mus musculus
tttagccctgtcaggaactgggacc

SEQ ID NO: 964700 - DNA, 25 bp, Mus musculus
tttagccctgtctggaactgggacc

SEQ ID NO: 964701 - DNA, 25 bp, Mus musculus
tttagcccttagcagctattgtaca

SEQ ID NO: 964702 - DNA, 25 bp, Mus musculus
tttagcccttaggagctattgtaca

SEQ ID NO: 964703 - DNA, 25 bp, Mus musculus
tttagccgccagaacagtcgggagc

SEQ ID NO: 964704 - DNA, 25 bp, Mus musculus
tttagccgccagtacagtcgggagc

SEQ ID NO: 964705 - DNA, 25 bp, Mus musculus
tttagccgcctgattaaatgcaccg

SEQ ID NO: 964706 - DNA, 25 bp, Mus musculus
tttagccgcctgtttaaatgcaccg

SEQ ID NO: 964707 - DNA, 25 bp, Mus musculus
tttagccgggtacagaggcattccc

SEQ ID NO: 964708 - DNA, 25 bp, Mus musculus
tttagccgggtagagaggcattccc

SEQ ID NO: 964709 - DNA, 25 bp, Mus musculus
tttagccgtggaccccgctttctct

SEQ ID NO: 964710 - DNA, 25 bp, Mus musculus
tttagccgtggagcccgctttctct

SEQ ID NO: 964711 - DNA, 25 bp, Mus musculus
tttagcctatgaaatcatcctgacg

SEQ ID NO: 964712 - DNA, 25 bp, Mus musculus
tttagcctatgatatcatcctgacg

SEQ ID NO: 964713 - DNA, 25 bp, Mus musculus
tttagcctgcctaggaaagcctatc

SEQ ID NO: 964714 - DNA, 25 bp, Mus musculus
tttagcctgccttggaaagcctatc

SEQ ID NO: 964715 - DNA, 25 bp, Mus musculus
tttagcctggaaagtaagttttatg

SEQ ID NO: 964716 - DNA, 25 bp, Mus musculus
tttagcctggaatgtaagttttatg

SEQ ID NO: 964717 - DNA, 25 bp, Mus musculus
tttagcctgtttcctaccttttttg

SEQ ID NO: 964718 - DNA, 25 bp, Mus musculus
tttagcctgtttgctaccttttttg

SEQ ID NO: 964719 - DNA, 25 bp, Mus musculus
tttagccttcaacatgcttcccaga

SEQ ID NO: 964720 - DNA, 25 bp, Mus musculus
tttagccttcaagatgcttcccaga

SEQ ID NO: 964721 - DNA, 25 bp, Mus musculus
tttagccttgcgatgcacctgtatg

SEQ ID NO: 964722 - DNA, 25 bp, Mus musculus
tttagccttgcgttgcacctgtatg

SEQ ID NO: 964723 - DNA, 25 bp, Mus musculus
tttagccttgctcggcaagtagatg

SEQ ID NO: 964724 - DNA, 25 bp, Mus musculus
tttagccttgctgggcaagtagatg

SEQ ID NO: 964725 - DNA, 25 bp, Mus musculus
tttagcctttctccgcctctgagtt

SEQ ID NO: 964726 - DNA, 25 bp, Mus musculus
tttagcctttctgcgcctctgagtt

SEQ ID NO: 964727 - DNA, 25 bp, Mus musculus
tttagcctttgtcggaaagagtaag

SEQ ID NO: 964728 - DNA, 25 bp, Mus musculus
tttagcctttgtgggaaagagtaag

SEQ ID NO: 964729 - DNA, 25 bp, Mus musculus
tttagcgacaagagatgagcatctc

SEQ ID NO: 964730 - DNA, 25 bp, Mus musculus
tttagcgacaagcatggcctcacag

SEQ ID NO: 964731 - DNA, 25 bp, Mus musculus
tttagcgacaaggatggcctcacag

SEQ ID NO: 964732 - DNA, 25 bp, Mus musculus
tttagcgacaagtgatgagcatctc

SEQ ID NO: 964733 - DNA, 25 bp, Mus musculus
tttagcgactaccacaatgctctcc

SEQ ID NO: 964734 - DNA, 25 bp, Mus musculus
tttagcgactacgacaatgctctcc

SEQ ID NO: 964735 - DNA, 25 bp, Mus musculus
tttagcgagctacgactggtgacca

SEQ ID NO: 964736 - DNA, 25 bp, Mus musculus
tttagcgagctaggactggtgacca

SEQ ID NO: 964737 - DNA, 25 bp, Mus musculus
tttagcgatcctcttacctcaaaat

SEQ ID NO: 964738 - DNA, 25 bp, Mus musculus
tttagcgatcctgttacctcaaaat

SEQ ID NO: 964739 - DNA, 25 bp, Mus musculus
tttagcgcacaccagaagacactct

SEQ ID NO: 964740 - DNA, 25 bp, Mus musculus
tttagcgcacacgagaagacactct

SEQ ID NO: 964741 - DNA, 25 bp, Mus musculus
tttagcgcacagcagaaattttatg

SEQ ID NO: 964742 - DNA, 25 bp, Mus musculus
tttagcgcacaggagaaattttatg

SEQ ID NO: 964743 - DNA, 25 bp, Mus musculus
tttagcgccatgattagatagaatg

SEQ ID NO: 964744 - DNA, 25 bp, Mus musculus
tttagcgccatgtttagatagaatg

SEQ ID NO: 964745 - DNA, 25 bp, Mus musculus
tttagcggcacgaacgatccctgcg

SEQ ID NO: 964746 - DNA, 25 bp, Mus musculus
tttagcggcacgtacgatccctgcg

SEQ ID NO: 964747 - DNA, 25 bp, Mus musculus
tttagcgggaaccttccagcactaa

SEQ ID NO: 964748 - DNA, 25 bp, Mus musculus
tttagcgggaacgttccagcactaa

SEQ ID NO: 964749 - DNA, 25 bp, Mus musculus
tttagcgggtcacctacaggagcat

SEQ ID NO: 964750 - DNA, 25 bp, Mus musculus
tttagcgggtcagctacaggagcat

SEQ ID NO: 964751 - DNA, 25 bp, Mus musculus
tttagcggtcaaaattattaagcct

SEQ ID NO: 964752 - DNA, 25 bp, Mus musculus
tttagcggtcaatattattaagcct

SEQ ID NO: 964753 - DNA, 25 bp, Mus musculus
tttagcgtgatacccactttcgaat

SEQ ID NO: 964754 - DNA, 25 bp, Mus musculus
tttagcgtgatagccactttcgaat

SEQ ID NO: 964755 - DNA, 25 bp, Mus musculus
tttagcgttgcaagtagccaggtgt

SEQ ID NO: 964756 - DNA, 25 bp, Mus musculus
tttagcgttgcatgtagccaggtgt

SEQ ID NO: 964757 - DNA, 25 bp, Mus musculus
tttagctaaaatctgcacctgcaga

SEQ ID NO: 964758 - DNA, 25 bp, Mus musculus
tttagctaaaatgtgcacctgcaga

SEQ ID NO: 964759 - DNA, 25 bp, Mus musculus
tttagctacattattggcaccttgt

SEQ ID NO: 964760 - DNA, 25 bp, Mus musculus
tttagctacatttttggcaccttgt

SEQ ID NO: 964761 - DNA, 25 bp, Mus musculus
tttagctaccaaactggctgcatct

SEQ ID NO: 964762 - DNA, 25 bp, Mus musculus
tttagctaccaatctggctgcatct

SEQ ID NO: 964763 - DNA, 25 bp, Mus musculus
tttagctaccagcaaccagtgattg

SEQ ID NO: 964764 - DNA, 25 bp, Mus musculus
tttagctaccaggaaccagtgattg

SEQ ID NO: 964765 - DNA, 25 bp, Mus musculus
tttagctacccactgtgttactctg

SEQ ID NO: 964766 - DNA, 25 bp, Mus musculus
tttagctacccagtgtgttactctg

SEQ ID NO: 964767 - DNA, 25 bp, Mus musculus
tttagctagctcatcttacactctg

SEQ ID NO: 964768 - DNA, 25 bp, Mus musculus
tttagctagctcttcttacactctg

SEQ ID NO: 964769 - DNA, 25 bp, Mus musculus
tttagctatagcacaccaatggcta

SEQ ID NO: 964770 - DNA, 25 bp, Mus musculus
tttagctatagctcaccaatggcta

SEQ ID NO: 964771 - DNA, 25 bp, Mus musculus
tttagctcatctaccagaagccact

SEQ ID NO: 964772 - DNA, 25 bp, Mus musculus
tttagctcatctccaatgtttccat

SEQ ID NO: 964773 - DNA, 25 bp, Mus musculus
tttagctcatctgcaatgtttccat

SEQ ID NO: 964774 - DNA, 25 bp, Mus musculus
tttagctcatcttccagaagccact

SEQ ID NO: 964775 - DNA, 25 bp, Mus musculus
tttagctctaagaacttgaccagtg

SEQ ID NO: 964776 - DNA, 25 bp, Mus musculus
tttagctctaagtacttgaccagtg

SEQ ID NO: 964777 - DNA, 25 bp, Mus musculus
tttagctctaccacacttttactgt

SEQ ID NO: 964778 - DNA, 25 bp, Mus musculus
tttagctctacctcacttttactgt

SEQ ID NO: 964779 - DNA, 25 bp, Mus musculus
tttagctctagtattctgaggttct

SEQ ID NO: 964780 - DNA, 25 bp, Mus musculus
tttagctctagttttctgaggttct

SEQ ID NO: 964781 - DNA, 25 bp, Mus musculus
tttagctctcttcaaatccatcggt

SEQ ID NO: 964782 - DNA, 25 bp, Mus musculus
tttagctctcttgaaatccatcggt

SEQ ID NO: 964783 - DNA, 25 bp, Mus musculus
tttagctctgctatgttgaggaaga

SEQ ID NO: 964784 - DNA, 25 bp, Mus musculus
tttagctctgctttgttgaggaaga

SEQ ID NO: 964785 - DNA, 25 bp, Mus musculus
tttagctctgtacttgagccctcat

SEQ ID NO: 964786 - DNA, 25 bp, Mus musculus
tttagctctgtagttgagccctcat

SEQ ID NO: 964787 - DNA, 25 bp, Mus musculus
tttagctctgtgagattcctgcaat

SEQ ID NO: 964788 - DNA, 25 bp, Mus musculus
tttagctctgtgtgattcctgcaat

SEQ ID NO: 964789 - DNA, 25 bp, Mus musculus
tttagctcttcaaaagccctctctt

SEQ ID NO: 964790 - DNA, 25 bp, Mus musculus
tttagctcttcataagccctctctt

SEQ ID NO: 964791 - DNA, 25 bp, Mus musculus
tttagctgctacaataggattggat

SEQ ID NO: 964792 - DNA, 25 bp, Mus musculus
tttagctgctactataggattggat

SEQ ID NO: 964793 - DNA, 25 bp, Mus musculus
tttagctgcttcctttctcatgaaa

SEQ ID NO: 964794 - DNA, 25 bp, Mus musculus
tttagctgcttcgtttctcatgaaa

SEQ ID NO: 964795 - DNA, 25 bp, Mus musculus
tttagctgtagcctggaatccatat

SEQ ID NO: 964796 - DNA, 25 bp, Mus musculus
tttagctgtagcgtggaatccatat

SEQ ID NO: 964797 - DNA, 25 bp, Mus musculus
tttagctgtagtcacgagttctcgc

SEQ ID NO: 964798 - DNA, 25 bp, Mus musculus
tttagctgtagtgacgagttctcgc

SEQ ID NO: 964799 - DNA, 25 bp, Mus musculus
tttagctgtttcaatgagatcgagc

SEQ ID NO: 964800 - DNA, 25 bp, Mus musculus
tttagctgtttctatgagatcgagc

SEQ ID NO: 964801 - DNA, 25 bp, Mus musculus
tttagctgtttgcaacagagttgtt

SEQ ID NO: 964802 - DNA, 25 bp, Mus musculus
tttagctgtttggaacagagttgtt

SEQ ID NO: 964803 - DNA, 25 bp, Mus musculus
tttagcttccttctttccaggatct

SEQ ID NO: 964804 - DNA, 25 bp, Mus musculus
tttagcttccttgtttccaggatct

SEQ ID NO: 964805 - DNA, 25 bp, Mus musculus
tttagcttctgcctgatactgatcc

SEQ ID NO: 964806 - DNA, 25 bp, Mus musculus
tttagcttctgcgtgatactgatcc

SEQ ID NO: 964807 - DNA, 25 bp, Mus musculus
tttagcttgagacacctaggatacg

SEQ ID NO: 964808 - DNA, 25 bp, Mus musculus
tttagcttgagagacctaggatacg

SEQ ID NO: 964809 - DNA, 25 bp, Mus musculus
tttagcttggctctatccctgagat

SEQ ID NO: 964810 - DNA, 25 bp, Mus musculus
tttagcttggctgtatccctgagat

SEQ ID NO: 964811 - DNA, 25 bp, Mus musculus
tttagctttgatccccatgatcctt

SEQ ID NO: 964812 - DNA, 25 bp, Mus musculus
tttagctttgatgcccatgatcctt

SEQ ID NO: 964813 - DNA, 25 bp, Mus musculus
tttagctttggaaccactcatgccc

SEQ ID NO: 964814 - DNA, 25 bp, Mus musculus
tttagctttggatccactcatgccc

SEQ ID NO: 964815 - DNA, 25 bp, Mus musculus
tttagctttgtgatgattggtgttt

SEQ ID NO: 964816 - DNA, 25 bp, Mus musculus
tttagctttgtgttgattggtgttt

SEQ ID NO: 964817 - DNA, 25 bp, Mus musculus
tttaggaaacccatgcttcagacgc

SEQ ID NO: 964818 - DNA, 25 bp, Mus musculus
tttaggaaacccttgcttcagacgc

SEQ ID NO: 964819 - DNA, 25 bp, Mus musculus
tttaggaaactcaatgctcgccgga

SEQ ID NO: 964820 - DNA, 25 bp, Mus musculus
tttaggaaactctatgctcgccgga

SEQ ID NO: 964821 - DNA, 25 bp, Mus musculus
tttaggaaccacacccatttatttg

SEQ ID NO: 964822 - DNA, 25 bp, Mus musculus
tttaggaaccactcccatttatttg

SEQ ID NO: 964823 - DNA, 25 bp, Mus musculus
tttaggaacctgcaacagtccactg

SEQ ID NO: 964824 - DNA, 25 bp, Mus musculus
tttaggaacctgcttgatccctctc

SEQ ID NO: 964825 - DNA, 25 bp, Mus musculus
tttaggaacctggaacagtccactg

SEQ ID NO: 964826 - DNA, 25 bp, Mus musculus
tttaggaacctggttgatccctctc

SEQ ID NO: 964827 - DNA, 25 bp, Mus musculus
tttaggaactgcctgcttttcacct

SEQ ID NO: 964828 - DNA, 25 bp, Mus musculus
tttaggaactgcgtgcttttcacct

SEQ ID NO: 964829 - DNA, 25 bp, Mus musculus
tttaggaagcatactcgctgcacca

SEQ ID NO: 964830 - DNA, 25 bp, Mus musculus
tttaggaagcattctcgctgcacca

SEQ ID NO: 964831 - DNA, 25 bp, Mus musculus
tttaggaatctaaccaacctccctg

SEQ ID NO: 964832 - DNA, 25 bp, Mus musculus
tttaggaatctacctgccacattta

SEQ ID NO: 964833 - DNA, 25 bp, Mus musculus
tttaggaatctagctgccacattta

SEQ ID NO: 964834 - DNA, 25 bp, Mus musculus
tttaggaatctatccaacctccctg

SEQ ID NO: 964835 - DNA, 25 bp, Mus musculus
tttaggaattgactgagtgcgccca

SEQ ID NO: 964836 - DNA, 25 bp, Mus musculus
tttaggaattgagtgagtgcgccca

SEQ ID NO: 964837 - DNA, 25 bp, Mus musculus
tttaggacaagacagcatagtaaga

SEQ ID NO: 964838 - DNA, 25 bp, Mus musculus
tttaggacaagagagcatagtaaga

SEQ ID NO: 964839 - DNA, 25 bp, Mus musculus
tttaggacttaacactcctcggtct

SEQ ID NO: 964840 - DNA, 25 bp, Mus musculus
tttaggacttaagactcctcggtct

SEQ ID NO: 964841 - DNA, 25 bp, Mus musculus
tttaggagacaaagcccctttccat

SEQ ID NO: 964842 - DNA, 25 bp, Mus musculus
tttaggagacaatgcccctttccat

SEQ ID NO: 964843 - DNA, 25 bp, Mus musculus
tttaggagagacacaccgcttgttc

SEQ ID NO: 964844 - DNA, 25 bp, Mus musculus
tttaggagagactcaccgcttgttc

SEQ ID NO: 964845 - DNA, 25 bp, Mus musculus
tttaggatgtttacttgggagctgg

SEQ ID NO: 964846 - DNA, 25 bp, Mus musculus
tttaggatgttttcttgggagctgg

SEQ ID NO: 964847 - DNA, 25 bp, Mus musculus
tttaggattctacagctgccaaatg

SEQ ID NO: 964848 - DNA, 25 bp, Mus musculus
tttaggattctagagctgccaaatg

SEQ ID NO: 964849 - DNA, 25 bp, Mus musculus
tttaggattgcaaaacgtacgccag

SEQ ID NO: 964850 - DNA, 25 bp, Mus musculus
tttaggattgcataacgtacgccag

SEQ ID NO: 964851 - DNA, 25 bp, Mus musculus
tttaggcaaaagaccgggcacctat

SEQ ID NO: 964852 - DNA, 25 bp, Mus musculus
tttaggcaaaagtccgggcacctat

SEQ ID NO: 964853 - DNA, 25 bp, Mus musculus
tttaggcacaacactcgaaagactt

SEQ ID NO: 964854 - DNA, 25 bp, Mus musculus
tttaggcacaactctcgaaagactt

SEQ ID NO: 964855 - DNA, 25 bp, Mus musculus
tttaggcactggatctgatcatttt

SEQ ID NO: 964856 - DNA, 25 bp, Mus musculus
tttaggcactggttctgatcatttt

SEQ ID NO: 964857 - DNA, 25 bp, Mus musculus
tttaggcagggtcctcaagtcctcc

SEQ ID NO: 964858 - DNA, 25 bp, Mus musculus
tttaggcagggtgctcaagtcctcc

SEQ ID NO: 964859 - DNA, 25 bp, Mus musculus
tttaggcaggtcaatatagcccagg

SEQ ID NO: 964860 - DNA, 25 bp, Mus musculus
tttaggcaggtctatatagcccagg

SEQ ID NO: 964861 - DNA, 25 bp, Mus musculus
tttaggccacgtcggctacatagca

SEQ ID NO: 964862 - DNA, 25 bp, Mus musculus
tttaggccacgtgggctacatagca

SEQ ID NO: 964863 - DNA, 25 bp, Mus musculus
tttaggccaggcacattccacggtt

SEQ ID NO: 964864 - DNA, 25 bp, Mus musculus
tttaggccaggctcattccacggtt

SEQ ID NO: 964865 - DNA, 25 bp, Mus musculus
tttaggcccaaactcaggtggtttg

SEQ ID NO: 964866 - DNA, 25 bp, Mus musculus
tttaggcccaaagtcaggtggtttg

SEQ ID NO: 964867 - DNA, 25 bp, Mus musculus
tttaggccctcaatattcttgtaag

SEQ ID NO: 964868 - DNA, 25 bp, Mus musculus
tttaggccctcattattcttgtaag

SEQ ID NO: 964869 - DNA, 25 bp, Mus musculus
tttaggccgtgaccagccgcagcga

SEQ ID NO: 964870 - DNA, 25 bp, Mus musculus
tttaggccgtgagcagccgcagcga

SEQ ID NO: 964871 - DNA, 25 bp, Mus musculus
tttaggcctcttcctgtactagaaa

SEQ ID NO: 964872 - DNA, 25 bp, Mus musculus
tttaggcctcttgctgtactagaaa

SEQ ID NO: 964873 - DNA, 25 bp, Mus musculus
tttaggcgaccccacattcctctcc

SEQ ID NO: 964874 - DNA, 25 bp, Mus musculus
tttaggcgacccgacattcctctcc

SEQ ID NO: 964875 - DNA, 25 bp, Mus musculus
tttaggcgggctacaagttgtgtgt

SEQ ID NO: 964876 - DNA, 25 bp, Mus musculus
tttaggcgggcttcaagttgtgtgt

SEQ ID NO: 964877 - DNA, 25 bp, Mus musculus
tttaggcgtagcacacatcttctga

SEQ ID NO: 964878 - DNA, 25 bp, Mus musculus
tttaggcgtagctcacatcttctga

SEQ ID NO: 964879 - DNA, 25 bp, Mus musculus
tttaggctactgcagcttaggtata

SEQ ID NO: 964880 - DNA, 25 bp, Mus musculus
tttaggctactggagcttaggtata

SEQ ID NO: 964881 - DNA, 25 bp, Mus musculus
tttaggctccatctgtccaggttga

SEQ ID NO: 964882 - DNA, 25 bp, Mus musculus
tttaggctccatgtgtccaggttga

SEQ ID NO: 964883 - DNA, 25 bp, Mus musculus
tttaggctctgaacccagaggtcag

SEQ ID NO: 964884 - DNA, 25 bp, Mus musculus
tttaggctctgatcccagaggtcag

SEQ ID NO: 964885 - DNA, 25 bp, Mus musculus
tttaggctgcgtacagacaggacct

SEQ ID NO: 964886 - DNA, 25 bp, Mus musculus
tttaggctgcgttcagacaggacct

SEQ ID NO: 964887 - DNA, 25 bp, Mus musculus
tttaggctggctctgaactcatatt

SEQ ID NO: 964888 - DNA, 25 bp, Mus musculus
tttaggctggctgtgaactcatatt

SEQ ID NO: 964889 - DNA, 25 bp, Mus musculus
tttaggcttctcatggtttgttttg

SEQ ID NO: 964890 - DNA, 25 bp, Mus musculus
tttaggcttctcttggtttgttttg

SEQ ID NO: 964891 - DNA, 25 bp, Mus musculus
tttaggcttgttaatctctttggaa

SEQ ID NO: 964892 - DNA, 25 bp, Mus musculus
tttaggcttgtttatctctttggaa

SEQ ID NO: 964893 - DNA, 25 bp, Mus musculus
tttaggctttggagtaccaccatcc

SEQ ID NO: 964894 - DNA, 25 bp, Mus musculus
tttaggctttggtgtaccaccatcc

SEQ ID NO: 964895 - DNA, 25 bp, Mus musculus
tttagggacagcagctgtgtacact

SEQ ID NO: 964896 - DNA, 25 bp, Mus musculus
tttagggacagcctgggcatcctag

SEQ ID NO: 964897 - DNA, 25 bp, Mus musculus
tttagggacagcgtgggcatcctag

SEQ ID NO: 964898 - DNA, 25 bp, Mus musculus
tttagggacagctgctgtgtacact

SEQ ID NO: 964899 - DNA, 25 bp, Mus musculus
tttagggacatgcagcagggaggga

SEQ ID NO: 964900 - DNA, 25 bp, Mus musculus
tttagggacatggagcagggaggga

SEQ ID NO: 964901 - DNA, 25 bp, Mus musculus
tttagggatttgcttctttctgcct

SEQ ID NO: 964902 - DNA, 25 bp, Mus musculus
tttagggatttggttctttctgcct

SEQ ID NO: 964903 - DNA, 25 bp, Mus musculus
tttagggcaagaccaggcataaact

SEQ ID NO: 964904 - DNA, 25 bp, Mus musculus
tttagggcaagagcaggcataaact

SEQ ID NO: 964905 - DNA, 25 bp, Mus musculus
tttagggcacttatagggcaaaggc

SEQ ID NO: 964906 - DNA, 25 bp, Mus musculus
tttagggcacttttagggcaaaggc

SEQ ID NO: 964907 - DNA, 25 bp, Mus musculus
tttagggccactcgaattttccact

SEQ ID NO: 964908 - DNA, 25 bp, Mus musculus
tttagggccactggaattttccact

SEQ ID NO: 964909 - DNA, 25 bp, Mus musculus
tttagggcccgacgaatagcatgaa

SEQ ID NO: 964910 - DNA, 25 bp, Mus musculus
tttagggcccgaggaatagcatgaa

SEQ ID NO: 964911 - DNA, 25 bp, Mus musculus
tttagggcctagatgttctcaagaa

SEQ ID NO: 964912 - DNA, 25 bp, Mus musculus
tttagggcctagttgttctcaagaa

SEQ ID NO: 964913 - DNA, 25 bp, Mus musculus
tttagggctcccaggactgaacttg

SEQ ID NO: 964914 - DNA, 25 bp, Mus musculus
tttagggctccctggactgaacttg

SEQ ID NO: 964915 - DNA, 25 bp, Mus musculus
tttagggcttttctcatgttgaaga

SEQ ID NO: 964916 - DNA, 25 bp, Mus musculus
tttagggcttttgtcatgttgaaga

SEQ ID NO: 964917 - DNA, 25 bp, Mus musculus
tttagggtagacagccccattcagg

SEQ ID NO: 964918 - DNA, 25 bp, Mus musculus
tttagggtagactgccccattcagg

SEQ ID NO: 964919 - DNA, 25 bp, Mus musculus
tttagggtatttacctgtctcatct

SEQ ID NO: 964920 - DNA, 25 bp, Mus musculus
tttagggtatttatgaacggcacag

SEQ ID NO: 964921 - DNA, 25 bp, Mus musculus
tttagggtattttcctgtctcatct

SEQ ID NO: 964922 - DNA, 25 bp, Mus musculus
tttagggtatttttgaacggcacag

SEQ ID NO: 964923 - DNA, 25 bp, Mus musculus
tttagggtcagtcttctgatgcatc

SEQ ID NO: 964924 - DNA, 25 bp, Mus musculus
tttagggtcagtgttctgatgcatc

SEQ ID NO: 964925 - DNA, 25 bp, Mus musculus
tttagggtctacatcttccccttat

SEQ ID NO: 964926 - DNA, 25 bp, Mus musculus
tttagggtctacttcttccccttat

SEQ ID NO: 964927 - DNA, 25 bp, Mus musculus
tttagggtctggagatcacacatcc

SEQ ID NO: 964928 - DNA, 25 bp, Mus musculus
tttagggtctggtgatcacacatcc

SEQ ID NO: 964929 - DNA, 25 bp, Mus musculus
tttagggtgcccactctaggtcttc

SEQ ID NO: 964930 - DNA, 25 bp, Mus musculus
tttagggtgccctctctaggtcttc

SEQ ID NO: 964931 - DNA, 25 bp, Mus musculus
tttagggtgtgccttattctgctca

SEQ ID NO: 964932 - DNA, 25 bp, Mus musculus
tttagggtgtgcgttattctgctca

SEQ ID NO: 964933 - DNA, 25 bp, Mus musculus
tttagggttactctggcgtcttagc

SEQ ID NO: 964934 - DNA, 25 bp, Mus musculus
tttagggttactgtggcgtcttagc

SEQ ID NO: 964935 - DNA, 25 bp, Mus musculus
tttagggtttgtaccattctcactt

SEQ ID NO: 964936 - DNA, 25 bp, Mus musculus
tttagggtttgttccattctcactt

SEQ ID NO: 964937 - DNA, 25 bp, Mus musculus
tttagggttttcagtgtgtcctttg

SEQ ID NO: 964938 - DNA, 25 bp, Mus musculus
tttagggttttctgtgtgtcctttg

SEQ ID NO: 964939 - DNA, 25 bp, Mus musculus
tttaggtaagtcactcttgttatca

SEQ ID NO: 964940 - DNA, 25 bp, Mus musculus
tttaggtaagtctctcttgttatca

SEQ ID NO: 964941 - DNA, 25 bp, Mus musculus
tttaggtaatgcagatcccttccct

SEQ ID NO: 964942 - DNA, 25 bp, Mus musculus
tttaggtaatgctgatcccttccct

SEQ ID NO: 964943 - DNA, 25 bp, Mus musculus
tttaggtatctcagtctccccttct

SEQ ID NO: 964944 - DNA, 25 bp, Mus musculus
tttaggtatctctgtctccccttct

SEQ ID NO: 964945 - DNA, 25 bp, Mus musculus
tttaggtatctgctgccttgtggtc

SEQ ID NO: 964946 - DNA, 25 bp, Mus musculus
tttaggtatctggtgccttgtggtc

SEQ ID NO: 964947 - DNA, 25 bp, Mus musculus
tttaggtattggctcatctctttcc

SEQ ID NO: 964948 - DNA, 25 bp, Mus musculus
tttaggtattgggtcatctctttcc

SEQ ID NO: 964949 - DNA, 25 bp, Mus musculus
tttaggtcagcaccaaggccctctt

SEQ ID NO: 964950 - DNA, 25 bp, Mus musculus
tttaggtcagcagcaaggccctctt

SEQ ID NO: 964951 - DNA, 25 bp, Mus musculus
tttaggtcagccaagcacatttttt

SEQ ID NO: 964952 - DNA, 25 bp, Mus musculus
tttaggtcagcctagcacatttttt

SEQ ID NO: 964953 - DNA, 25 bp, Mus musculus
tttaggtcatagattgggtgctctt

SEQ ID NO: 964954 - DNA, 25 bp, Mus musculus
tttaggtcatagtttgggtgctctt

SEQ ID NO: 964955 - DNA, 25 bp, Mus musculus
tttaggtcatgcagcaagcaccttt

SEQ ID NO: 964956 - DNA, 25 bp, Mus musculus
tttaggtcatgctgcaagcaccttt

SEQ ID NO: 964957 - DNA, 25 bp, Mus musculus
tttaggtccagcctgaattacagtg

SEQ ID NO: 964958 - DNA, 25 bp, Mus musculus
tttaggtccagcgtgaattacagtg

SEQ ID NO: 964959 - DNA, 25 bp, Mus musculus
tttaggtccagtcagaaacccttct

SEQ ID NO: 964960 - DNA, 25 bp, Mus musculus
tttaggtccagtgagaaacccttct

SEQ ID NO: 964961 - DNA, 25 bp, Mus musculus
tttaggtccatccacattgaagcat

SEQ ID NO: 964962 - DNA, 25 bp, Mus musculus
tttaggtccatcgacattgaagcat

SEQ ID NO: 964963 - DNA, 25 bp, Mus musculus
tttaggtctctgcttttcctttcct

SEQ ID NO: 964964 - DNA, 25 bp, Mus musculus
tttaggtctctggttttcctttcct

SEQ ID NO: 964965 - DNA, 25 bp, Mus musculus
tttaggtggctaatcccaacatttg

SEQ ID NO: 964966 - DNA, 25 bp, Mus musculus
tttaggtggctattcccaacatttg

SEQ ID NO: 964967 - DNA, 25 bp, Mus musculus
tttaggtgggtaatcatcggctgcc

SEQ ID NO: 964968 - DNA, 25 bp, Mus musculus
tttaggtgggtattcatcggctgcc

SEQ ID NO: 964969 - DNA, 25 bp, Mus musculus
tttaggtggtctatggtgcccctct

SEQ ID NO: 964970 - DNA, 25 bp, Mus musculus
tttaggtggtctttggtgcccctct

SEQ ID NO: 964971 - DNA, 25 bp, Mus musculus
tttaggtgtgtgcagacatgaccac

SEQ ID NO: 964972 - DNA, 25 bp, Mus musculus
tttaggtgtgtgctttccatgactg

SEQ ID NO: 964973 - DNA, 25 bp, Mus musculus
tttaggtgtgtggagacatgaccac

SEQ ID NO: 964974 - DNA, 25 bp, Mus musculus
tttaggtgtgtggtttccatgactg

SEQ ID NO: 964975 - DNA, 25 bp, Mus musculus
tttaggttacaacaagcatctcacc

SEQ ID NO: 964976 - DNA, 25 bp, Mus musculus
tttaggttacaagaagcatctcacc

SEQ ID NO: 964977 - DNA, 25 bp, Mus musculus
tttaggttattgattagttgctgaa

SEQ ID NO: 964978 - DNA, 25 bp, Mus musculus
tttaggttattgtttagttgctgaa

SEQ ID NO: 964979 - DNA, 25 bp, Mus musculus
tttaggttccagatgacttacgtca

SEQ ID NO: 964980 - DNA, 25 bp, Mus musculus
tttaggttccagttgacttacgtca

SEQ ID NO: 964981 - DNA, 25 bp, Mus musculus
tttaggttgatcctggagactccag

SEQ ID NO: 964982 - DNA, 25 bp, Mus musculus
tttaggttgatcgtggagactccag

SEQ ID NO: 964983 - DNA, 25 bp, Mus musculus
tttaggtttcatcgacttggtgtca

SEQ ID NO: 964984 - DNA, 25 bp, Mus musculus
tttaggtttcatggacttggtgtca

SEQ ID NO: 964985 - DNA, 25 bp, Mus musculus
tttagtaaatgcacttcccacaaat

SEQ ID NO: 964986 - DNA, 25 bp, Mus musculus
tttagtaaatgctcttcccacaaat

SEQ ID NO: 964987 - DNA, 25 bp, Mus musculus
tttagtaagattactggtttctgcc

SEQ ID NO: 964988 - DNA, 25 bp, Mus musculus
tttagtaagatttctggtttctgcc

SEQ ID NO: 964989 - DNA, 25 bp, Mus musculus
tttagtaatgtgcttgctgaccaaa

SEQ ID NO: 964990 - DNA, 25 bp, Mus musculus
tttagtaatgtggttgctgaccaaa

SEQ ID NO: 964991 - DNA, 25 bp, Mus musculus
tttagtaccccaccagtggatttac

SEQ ID NO: 964992 - DNA, 25 bp, Mus musculus
tttagtaccccactgtattgccttt

SEQ ID NO: 964993 - DNA, 25 bp, Mus musculus
tttagtaccccagcagtggatttac

SEQ ID NO: 964994 - DNA, 25 bp, Mus musculus
tttagtaccccagtgtattgccttt

SEQ ID NO: 964995 - DNA, 25 bp, Mus musculus
tttagtacccgaaccagtctcaagg

SEQ ID NO: 964996 - DNA, 25 bp, Mus musculus
tttagtacccgatccagtctcaagg

SEQ ID NO: 964997 - DNA, 25 bp, Mus musculus
tttagtacttagagccatcctgggt

SEQ ID NO: 964998 - DNA, 25 bp, Mus musculus
tttagtacttagtgccatcctgggt

SEQ ID NO: 964999 - DNA, 25 bp, Mus musculus
tttagtacttctctccagctgcacc

SEQ ID NO: 965000 - DNA, 25 bp, Mus musculus
tttagtacttctgtccagctgcacc

SEQ ID NO: 965001 - DNA, 25 bp, Mus musculus
tttagtagcagccaagggtcccagc

SEQ ID NO: 965002 - DNA, 25 bp, Mus musculus
tttagtagcagcgaagggtcccagc

SEQ ID NO: 965003 - DNA, 25 bp, Mus musculus
tttagtagtcacctctgatttcctc

SEQ ID NO: 965004 - DNA, 25 bp, Mus musculus
tttagtagtcacgtctgatttcctc

SEQ ID NO: 965005 - DNA, 25 bp, Mus musculus
tttagtagtctacagcttcctcgat

SEQ ID NO: 965006 - DNA, 25 bp, Mus musculus
tttagtagtctagagcttcctcgat

SEQ ID NO: 965007 - DNA, 25 bp, Mus musculus
tttagtagtttcaggtgccacccca

SEQ ID NO: 965008 - DNA, 25 bp, Mus musculus
tttagtagtttctggtgccacccca

SEQ ID NO: 965009 - DNA, 25 bp, Mus musculus
tttagtatggatatgcccctgtaat

SEQ ID NO: 965010 - DNA, 25 bp, Mus musculus
tttagtatggatttgcccctgtaat

SEQ ID NO: 965011 - DNA, 25 bp, Mus musculus
tttagtatggcacggtaacatttca

SEQ ID NO: 965012 - DNA, 25 bp, Mus musculus
tttagtatggcagggtaacatttca

SEQ ID NO: 965013 - DNA, 25 bp, Mus musculus
tttagtatggctagggatcagggcc

SEQ ID NO: 965014 - DNA, 25 bp, Mus musculus
tttagtatggcttgggatcagggcc

SEQ ID NO: 965015 - DNA, 25 bp, Mus musculus
tttagtatgtgtctgcaagcaggta

SEQ ID NO: 965016 - DNA, 25 bp, Mus musculus
tttagtatgtgtgtgcaagcaggta

SEQ ID NO: 965017 - DNA, 25 bp, Mus musculus
tttagtattataagtagcctttctt

SEQ ID NO: 965018 - DNA, 25 bp, Mus musculus
tttagtattatatgtagcctttctt

SEQ ID NO: 965019 - DNA, 25 bp, Mus musculus
tttagtattttactcactagccttt

SEQ ID NO: 965020 - DNA, 25 bp, Mus musculus
tttagtattttagtcactagccttt

SEQ ID NO: 965021 - DNA, 25 bp, Mus musculus
tttagtcaagacagattagtggttt

SEQ ID NO: 965022 - DNA, 25 bp, Mus musculus
tttagtcaagactgattagtggttt

SEQ ID NO: 965023 - DNA, 25 bp, Mus musculus
tttagtcaatgtatcctttccctca

SEQ ID NO: 965024 - DNA, 25 bp, Mus musculus
tttagtcaatgtttcctttccctca

SEQ ID NO: 965025 - DNA, 25 bp, Mus musculus
tttagtcaccccactgtagcctggg

SEQ ID NO: 965026 - DNA, 25 bp, Mus musculus
tttagtcacccctctgtagcctggg

SEQ ID NO: 965027 - DNA, 25 bp, Mus musculus
tttagtcactggacccagggtctaa

SEQ ID NO: 965028 - DNA, 25 bp, Mus musculus
tttagtcactggtcccagggtctaa

SEQ ID NO: 965029 - DNA, 25 bp, Mus musculus
tttagtcagtggactgccagtgtct

SEQ ID NO: 965030 - DNA, 25 bp, Mus musculus
tttagtcagtggtctgccagtgtct

SEQ ID NO: 965031 - DNA, 25 bp, Mus musculus
tttagtcatatcattcagctacaaa

SEQ ID NO: 965032 - DNA, 25 bp, Mus musculus
tttagtcatatctttcagctacaaa

SEQ ID NO: 965033 - DNA, 25 bp, Mus musculus
tttagtcattttagcttccacgtgt

SEQ ID NO: 965034 - DNA, 25 bp, Mus musculus
tttagtcatttttgcttccacgtgt

SEQ ID NO: 965035 - DNA, 25 bp, Mus musculus
tttagtccactaaccatttacccca

SEQ ID NO: 965036 - DNA, 25 bp, Mus musculus
tttagtccactatccatttacccca

SEQ ID NO: 965037 - DNA, 25 bp, Mus musculus
tttagtccatgcatctttgcatctc

SEQ ID NO: 965038 - DNA, 25 bp, Mus musculus
tttagtccatgcttctttgcatctc

SEQ ID NO: 965039 - DNA, 25 bp, Mus musculus
tttagtccccaaaactactggaaca

SEQ ID NO: 965040 - DNA, 25 bp, Mus musculus
tttagtccccaatactactggaaca

SEQ ID NO: 965041 - DNA, 25 bp, Mus musculus
tttagtcccctgactcattgggaag

SEQ ID NO: 965042 - DNA, 25 bp, Mus musculus
tttagtcccctgtctcattgggaag

SEQ ID NO: 965043 - DNA, 25 bp, Mus musculus
tttagtcccgtacccagggcctctt

SEQ ID NO: 965044 - DNA, 25 bp, Mus musculus
tttagtcccgtagccagggcctctt

SEQ ID NO: 965045 - DNA, 25 bp, Mus musculus
tttagtccctctatgaggactttgt

SEQ ID NO: 965046 - DNA, 25 bp, Mus musculus
tttagtccctctttgaggactttgt

SEQ ID NO: 965047 - DNA, 25 bp, Mus musculus
tttagtcctcacaacaaacccagca

SEQ ID NO: 965048 - DNA, 25 bp, Mus musculus
tttagtcctcactacaaacccagca

SEQ ID NO: 965049 - DNA, 25 bp, Mus musculus
tttagtcctgcgatggaaatcctga

SEQ ID NO: 965050 - DNA, 25 bp, Mus musculus
tttagtcctgcgttggaaatcctga

SEQ ID NO: 965051 - DNA, 25 bp, Mus musculus
tttagtcctgctctaatgcagcaca

SEQ ID NO: 965052 - DNA, 25 bp, Mus musculus
tttagtcctgctgtaatgcagcaca

SEQ ID NO: 965053 - DNA, 25 bp, Mus musculus
tttagtcgtcatctatctcagtctc

SEQ ID NO: 965054 - DNA, 25 bp, Mus musculus
tttagtcgtcatgtatctcagtctc

SEQ ID NO: 965055 - DNA, 25 bp, Mus musculus
tttagtctacatagctcttcccaga

SEQ ID NO: 965056 - DNA, 25 bp, Mus musculus
tttagtctacattgctcttcccaga

SEQ ID NO: 965057 - DNA, 25 bp, Mus musculus
tttagtctacccagagatgctccag

SEQ ID NO: 965058 - DNA, 25 bp, Mus musculus
tttagtctaccctgagatgctccag

SEQ ID NO: 965059 - DNA, 25 bp, Mus musculus
tttagtctcaatactcaggcagcag

SEQ ID NO: 965060 - DNA, 25 bp, Mus musculus
tttagtctcaattctcaggcagcag

SEQ ID NO: 965061 - DNA, 25 bp, Mus musculus
tttagtctccctaggcattgggaaa

SEQ ID NO: 965062 - DNA, 25 bp, Mus musculus
tttagtctcccttggcattgggaaa

SEQ ID NO: 965063 - DNA, 25 bp, Mus musculus
tttagtctgagaatgctcacccctg

SEQ ID NO: 965064 - DNA, 25 bp, Mus musculus
tttagtctgagattgctcacccctg

SEQ ID NO: 965065 - DNA, 25 bp, Mus musculus
tttagtcttcatagtactcctgtgc

SEQ ID NO: 965066 - DNA, 25 bp, Mus musculus
tttagtcttcattgtactcctgtgc

SEQ ID NO: 965067 - DNA, 25 bp, Mus musculus
tttagtcttgtgcttgcccttggtc

SEQ ID NO: 965068 - DNA, 25 bp, Mus musculus
tttagtcttgtggttgcccttggtc

SEQ ID NO: 965069 - DNA, 25 bp, Mus musculus
tttagtctttgtactattcctcaat

SEQ ID NO: 965070 - DNA, 25 bp, Mus musculus
tttagtctttgttctattcctcaat

SEQ ID NO: 965071 - DNA, 25 bp, Mus musculus
tttagtgaagtgatggtcacctggg

SEQ ID NO: 965072 - DNA, 25 bp, Mus musculus
tttagtgaagtgttggtcacctggg

SEQ ID NO: 965073 - DNA, 25 bp, Mus musculus
tttagtgaatatccaaaaccggcca

SEQ ID NO: 965074 - DNA, 25 bp, Mus musculus
tttagtgaatatgcaaaaccggcca

SEQ ID NO: 965075 - DNA, 25 bp, Mus musculus
tttagtgatgcacacatggctcagc

SEQ ID NO: 965076 - DNA, 25 bp, Mus musculus
tttagtgatgcagacatggctcagc

SEQ ID NO: 965077 - DNA, 25 bp, Mus musculus
tttagtgcatatactctacttcatg

SEQ ID NO: 965078 - DNA, 25 bp, Mus musculus
tttagtgcatattctctacttcatg

SEQ ID NO: 965079 - DNA, 25 bp, Mus musculus
tttagtgcattgctacttgggtagc

SEQ ID NO: 965080 - DNA, 25 bp, Mus musculus
tttagtgcattggtacttgggtagc

SEQ ID NO: 965081 - DNA, 25 bp, Mus musculus
tttagtgccactcttagacctgcca

SEQ ID NO: 965082 - DNA, 25 bp, Mus musculus
tttagtgccactgttagacctgcca

SEQ ID NO: 965083 - DNA, 25 bp, Mus musculus
tttagtgcccaactttgcagccata

SEQ ID NO: 965084 - DNA, 25 bp, Mus musculus
tttagtgcccaagtttgcagccata

SEQ ID NO: 965085 - DNA, 25 bp, Mus musculus
tttagtgccttaaatgcagcagaag

SEQ ID NO: 965086 - DNA, 25 bp, Mus musculus
tttagtgccttatatgcagcagaag

SEQ ID NO: 965087 - DNA, 25 bp, Mus musculus
tttagtgccttcaccagcttgcatc

SEQ ID NO: 965088 - DNA, 25 bp, Mus musculus
tttagtgccttctccagcttgcatc

SEQ ID NO: 965089 - DNA, 25 bp, Mus musculus
tttagtgctagccactgtttcaggc

SEQ ID NO: 965090 - DNA, 25 bp, Mus musculus
tttagtgctagcgactgtttcaggc

SEQ ID NO: 965091 - DNA, 25 bp, Mus musculus
tttagtgctcttcccgggcacctgg

SEQ ID NO: 965092 - DNA, 25 bp, Mus musculus
tttagtgctcttgccgggcacctgg

SEQ ID NO: 965093 - DNA, 25 bp, Mus musculus
tttagtgcttctagcagtgttcacc

SEQ ID NO: 965094 - DNA, 25 bp, Mus musculus
tttagtgcttctcaactccagggaa

SEQ ID NO: 965095 - DNA, 25 bp, Mus musculus
tttagtgcttctgaactccagggaa

SEQ ID NO: 965096 - DNA, 25 bp, Mus musculus
tttagtgcttcttgcagtgttcacc

SEQ ID NO: 965097 - DNA, 25 bp, Mus musculus
tttagtggaggtcagtcaggcctca

SEQ ID NO: 965098 - DNA, 25 bp, Mus musculus
tttagtggaggtgagtcaggcctca

SEQ ID NO: 965099 - DNA, 25 bp, Mus musculus
tttagtggatggctttggccagcct

SEQ ID NO: 965100 - DNA, 25 bp, Mus musculus
tttagtggatgggtttggccagcct

SEQ ID NO: 965101 - DNA, 25 bp, Mus musculus
tttagtggcactctctggtttgtaa

SEQ ID NO: 965102 - DNA, 25 bp, Mus musculus
tttagtggcactgtctggtttgtaa

SEQ ID NO: 965103 - DNA, 25 bp, Mus musculus
tttagtggctggctagttcctgtgt

SEQ ID NO: 965104 - DNA, 25 bp, Mus musculus
tttagtggctgggtagttcctgtgt

SEQ ID NO: 965105 - DNA, 25 bp, Mus musculus
tttagtgggacacagagccttcctt

SEQ ID NO: 965106 - DNA, 25 bp, Mus musculus
tttagtgggacagagagccttcctt

SEQ ID NO: 965107 - DNA, 25 bp, Mus musculus
tttagtgggttacctctttggaggt

SEQ ID NO: 965108 - DNA, 25 bp, Mus musculus
tttagtgggttagctctttggaggt

SEQ ID NO: 965109 - DNA, 25 bp, Mus musculus
tttagtggttttcctcagtctttta

SEQ ID NO: 965110 - DNA, 25 bp, Mus musculus
tttagtggttttgctcagtctttta

SEQ ID NO: 965111 - DNA, 25 bp, Mus musculus
tttagtgtaattctgtcctccacgg

SEQ ID NO: 965112 - DNA, 25 bp, Mus musculus
tttagtgtaattgtgtcctccacgg

SEQ ID NO: 965113 - DNA, 25 bp, Mus musculus
tttagtgtatctagctttttctcca

SEQ ID NO: 965114 - DNA, 25 bp, Mus musculus
tttagtgtatcttgctttttctcca

SEQ ID NO: 965115 - DNA, 25 bp, Mus musculus
tttagtgtcattatcacagatgctc

SEQ ID NO: 965116 - DNA, 25 bp, Mus musculus
tttagtgtcattttcacagatgctc

SEQ ID NO: 965117 - DNA, 25 bp, Mus musculus
tttagtgtccttagctttgggtcat

SEQ ID NO: 965118 - DNA, 25 bp, Mus musculus
tttagtgtcctttgctttgggtcat

SEQ ID NO: 965119 - DNA, 25 bp, Mus musculus
tttagtgtctctctcaccaagcaag

SEQ ID NO: 965120 - DNA, 25 bp, Mus musculus
tttagtgtctctgtcaccaagcaag

SEQ ID NO: 965121 - DNA, 25 bp, Mus musculus
tttagtgtctgaactctgacagggt

SEQ ID NO: 965122 - DNA, 25 bp, Mus musculus
tttagtgtctgatctctgacagggt

SEQ ID NO: 965123 - DNA, 25 bp, Mus musculus
tttagtgtggatcacccgtgttcct

SEQ ID NO: 965124 - DNA, 25 bp, Mus musculus
tttagtgtggatgacccgtgttcct

SEQ ID NO: 965125 - DNA, 25 bp, Mus musculus
tttagtgtggtcacggatttcccat

SEQ ID NO: 965126 - DNA, 25 bp, Mus musculus
tttagtgtggtctcggatttcccat

SEQ ID NO: 965127 - DNA, 25 bp, Mus musculus
tttagtgttaacacccttcctcatg

SEQ ID NO: 965128 - DNA, 25 bp, Mus musculus
tttagtgttaactcccttcctcatg

SEQ ID NO: 965129 - DNA, 25 bp, Mus musculus
tttagtgttccacattgggcataaa

SEQ ID NO: 965130 - DNA, 25 bp, Mus musculus
tttagtgttccagattgggcataaa

SEQ ID NO: 965131 - DNA, 25 bp, Mus musculus
tttagtgtttacatcctgcagtgaa

SEQ ID NO: 965132 - DNA, 25 bp, Mus musculus
tttagtgtttacttcctgcagtgaa

SEQ ID NO: 965133 - DNA, 25 bp, Mus musculus
tttagttaacttctttaggtccatg

SEQ ID NO: 965134 - DNA, 25 bp, Mus musculus
tttagttaacttgtttaggtccatg

SEQ ID NO: 965135 - DNA, 25 bp, Mus musculus
tttagttacaatatgcctagcacat

SEQ ID NO: 965136 - DNA, 25 bp, Mus musculus
tttagttacaatttgcctagcacat

SEQ ID NO: 965137 - DNA, 25 bp, Mus musculus
tttagttactttacctacatatcag

SEQ ID NO: 965138 - DNA, 25 bp, Mus musculus
tttagttacttttcctacatatcag

SEQ ID NO: 965139 - DNA, 25 bp, Mus musculus
tttagttagccccatgagtgttgtt

SEQ ID NO: 965140 - DNA, 25 bp, Mus musculus
tttagttagcccgatgagtgttgtt

SEQ ID NO: 965141 - DNA, 25 bp, Mus musculus
tttagttatgtccttctgttctgtc

SEQ ID NO: 965142 - DNA, 25 bp, Mus musculus
tttagttatgtcgttctgttctgtc

SEQ ID NO: 965143 - DNA, 25 bp, Mus musculus
tttagttcaatgcaagtcacttctc

SEQ ID NO: 965144 - DNA, 25 bp, Mus musculus
tttagttcaatggaagtcacttctc

SEQ ID NO: 965145 - DNA, 25 bp, Mus musculus
tttagttcacaaccacagcaggaaa

SEQ ID NO: 965146 - DNA, 25 bp, Mus musculus
tttagttcacaagcacagcaggaaa

SEQ ID NO: 965147 - DNA, 25 bp, Mus musculus
tttagttcagtcattttcccagtgc

SEQ ID NO: 965148 - DNA, 25 bp, Mus musculus
tttagttcagtctttttcccagtgc

SEQ ID NO: 965149 - DNA, 25 bp, Mus musculus
tttagttccagcactcaacttgtgc

SEQ ID NO: 965150 - DNA, 25 bp, Mus musculus
tttagttccagctctcaacttgtgc

SEQ ID NO: 965151 - DNA, 25 bp, Mus musculus
tttagttcctatcgcacttcttgct

SEQ ID NO: 965152 - DNA, 25 bp, Mus musculus
tttagttcctatggcacttcttgct

SEQ ID NO: 965153 - DNA, 25 bp, Mus musculus
tttagttcctctagggacagcatgt

SEQ ID NO: 965154 - DNA, 25 bp, Mus musculus
tttagttcctcttgggacagcatgt

SEQ ID NO: 965155 - DNA, 25 bp, Mus musculus
tttagttccttcaactttgagtatc

SEQ ID NO: 965156 - DNA, 25 bp, Mus musculus
tttagttccttctactttgagtatc

SEQ ID NO: 965157 - DNA, 25 bp, Mus musculus
tttagttcttagagccccagggcgg

SEQ ID NO: 965158 - DNA, 25 bp, Mus musculus
tttagttcttagtgccccagggcgg

SEQ ID NO: 965159 - DNA, 25 bp, Mus musculus
tttagttcttttcataacgtgtaat

SEQ ID NO: 965160 - DNA, 25 bp, Mus musculus
tttagttcttttgataacgtgtaat

SEQ ID NO: 965161 - DNA, 25 bp, Mus musculus
tttagttgactgatgccggtcactc

SEQ ID NO: 965162 - DNA, 25 bp, Mus musculus
tttagttgactgttgccggtcactc

SEQ ID NO: 965163 - DNA, 25 bp, Mus musculus
tttagttgggctcgaactcactatg

SEQ ID NO: 965164 - DNA, 25 bp, Mus musculus
tttagttgggctggaactcactatg

SEQ ID NO: 965165 - DNA, 25 bp, Mus musculus
tttagttgtagcaagcagggtgtta

SEQ ID NO: 965166 - DNA, 25 bp, Mus musculus
tttagttgtagctagcagggtgtta

SEQ ID NO: 965167 - DNA, 25 bp, Mus musculus
tttagttgtatgatgctggcagcct

SEQ ID NO: 965168 - DNA, 25 bp, Mus musculus
tttagttgtatgttgctggcagcct

SEQ ID NO: 965169 - DNA, 25 bp, Mus musculus
tttagttgtgtgagggaggaattcc

SEQ ID NO: 965170 - DNA, 25 bp, Mus musculus
tttagttgtgtgtgggaggaattcc

SEQ ID NO: 965171 - DNA, 25 bp, Mus musculus
tttagtttacctagctgatttaata

SEQ ID NO: 965172 - DNA, 25 bp, Mus musculus
tttagtttaccttgctgatttaata

SEQ ID NO: 965173 - DNA, 25 bp, Mus musculus
tttagtttacttcataagccccaag

SEQ ID NO: 965174 - DNA, 25 bp, Mus musculus
tttagtttacttgataagccccaag

SEQ ID NO: 965175 - DNA, 25 bp, Mus musculus
tttagtttagttacagctcctctgc

SEQ ID NO: 965176 - DNA, 25 bp, Mus musculus
tttagtttagtttcagctcctctgc

SEQ ID NO: 965177 - DNA, 25 bp, Mus musculus
tttagtttctcaagtctctctctca

SEQ ID NO: 965178 - DNA, 25 bp, Mus musculus
tttagtttctcatgtctctctctca

SEQ ID NO: 965179 - DNA, 25 bp, Mus musculus
tttagtttctggaacacagcctgat

SEQ ID NO: 965180 - DNA, 25 bp, Mus musculus
tttagtttctggtacacagcctgat

SEQ ID NO: 965181 - DNA, 25 bp, Mus musculus
tttagtttgaccattctgacctgac

SEQ ID NO: 965182 - DNA, 25 bp, Mus musculus
tttagtttgacctttctgacctgac

SEQ ID NO: 965183 - DNA, 25 bp, Mus musculus
tttagtttgcttccaatgattaaat

SEQ ID NO: 965184 - DNA, 25 bp, Mus musculus
tttagtttgcttgcaatgattaaat

SEQ ID NO: 965185 - DNA, 25 bp, Mus musculus
tttagttttggtagtctgagcctcc

SEQ ID NO: 965186 - DNA, 25 bp, Mus musculus
tttagttttggttgtctgagcctcc

SEQ ID NO: 965187 - DNA, 25 bp, Mus musculus
tttataaacagcatgccacatccct

SEQ ID NO: 965188 - DNA, 25 bp, Mus musculus
tttataaacagcttgccacatccct

SEQ ID NO: 965189 - DNA, 25 bp, Mus musculus
tttataaagaccagtagattcctac

SEQ ID NO: 965190 - DNA, 25 bp, Mus musculus
tttataaagacctgtagattcctac

SEQ ID NO: 965191 - DNA, 25 bp, Mus musculus
tttataaagattagctctcagtgtc

SEQ ID NO: 965192 - DNA, 25 bp, Mus musculus
tttataaagatttgctctcagtgtc

SEQ ID NO: 965193 - DNA, 25 bp, Mus musculus
tttataaatccccacctcctggtca

SEQ ID NO: 965194 - DNA, 25 bp, Mus musculus
tttataaatcccgacctcctggtca

SEQ ID NO: 965195 - DNA, 25 bp, Mus musculus
tttataaatgacatccggtggccac

SEQ ID NO: 965196 - DNA, 25 bp, Mus musculus
tttataaatgacttccggtggccac

SEQ ID NO: 965197 - DNA, 25 bp, Mus musculus
tttataaatggtccttgctgtatgc

SEQ ID NO: 965198 - DNA, 25 bp, Mus musculus
tttataaatggtgcttgctgtatgc

SEQ ID NO: 965199 - DNA, 25 bp, Mus musculus
tttataacaggccttatggcgcagg

SEQ ID NO: 965200 - DNA, 25 bp, Mus musculus
tttataacaggcgttatggcgcagg

SEQ ID NO: 965201 - DNA, 25 bp, Mus musculus
tttataacagtacagaggaggccaa

SEQ ID NO: 965202 - DNA, 25 bp, Mus musculus
tttataacagtagagaggaggccaa

SEQ ID NO: 965203 - DNA, 25 bp, Mus musculus
tttataacatgtactctcctttcac

SEQ ID NO: 965204 - DNA, 25 bp, Mus musculus
tttataacatgttctctcctttcac

SEQ ID NO: 965205 - DNA, 25 bp, Mus musculus
tttataacccctagacgcccatgaa

SEQ ID NO: 965206 - DNA, 25 bp, Mus musculus
tttataaccccttgacgcccatgaa

SEQ ID NO: 965207 - DNA, 25 bp, Mus musculus
tttataaccctgaagtgctcgacat

SEQ ID NO: 965208 - DNA, 25 bp, Mus musculus
tttataaccctgtagtgctcgacat

SEQ ID NO: 965209 - DNA, 25 bp, Mus musculus
tttataacctctactagcctggacc

SEQ ID NO: 965210 - DNA, 25 bp, Mus musculus
tttataacctcttctagcctggacc

SEQ ID NO: 965211 - DNA, 25 bp, Mus musculus
tttataactcaccacctttatcctt

SEQ ID NO: 965212 - DNA, 25 bp, Mus musculus
tttataactcacgacctttatcctt

SEQ ID NO: 965213 - DNA, 25 bp, Mus musculus
tttataacttctactagcctggacc

SEQ ID NO: 965214 - DNA, 25 bp, Mus musculus
tttataacttcttctagcctggacc

SEQ ID NO: 965215 - DNA, 25 bp, Mus musculus
tttataagacctcctgttcaaccgg

SEQ ID NO: 965216 - DNA, 25 bp, Mus musculus
tttataagacctgctgttcaaccgg

SEQ ID NO: 965217 - DNA, 25 bp, Mus musculus
tttataagcctaaaaccagcctccc

SEQ ID NO: 965218 - DNA, 25 bp, Mus musculus
tttataagcctataaccagcctccc

SEQ ID NO: 965219 - DNA, 25 bp, Mus musculus
tttataaggcacaagctgcccacct

SEQ ID NO: 965220 - DNA, 25 bp, Mus musculus
tttataaggcactagctgcccacct

SEQ ID NO: 965221 - DNA, 25 bp, Mus musculus
tttataagtgacaagccctttccgc

SEQ ID NO: 965222 - DNA, 25 bp, Mus musculus
tttataagtgactagccctttccgc

SEQ ID NO: 965223 - DNA, 25 bp, Mus musculus
tttataatagctacttgcagactga

SEQ ID NO: 965224 - DNA, 25 bp, Mus musculus
tttataatagcttcttgcagactga

SEQ ID NO: 965225 - DNA, 25 bp, Mus musculus
tttataatcgcacggcgtcaggccg

SEQ ID NO: 965226 - DNA, 25 bp, Mus musculus
tttataatcgcagggcgtcaggccg

SEQ ID NO: 965227 - DNA, 25 bp, Mus musculus
tttataatgaatactgagctcacat

SEQ ID NO: 965228 - DNA, 25 bp, Mus musculus
tttataatgaattctgagctcacat

SEQ ID NO: 965229 - DNA, 25 bp, Mus musculus
tttataatgcagaattccattcctt

SEQ ID NO: 965230 - DNA, 25 bp, Mus musculus
tttataatgcagtattccattcctt

SEQ ID NO: 965231 - DNA, 25 bp, Mus musculus
tttataatgcctcctaacccccaat

SEQ ID NO: 965232 - DNA, 25 bp, Mus musculus
tttataatgcctgctaacccccaat

SEQ ID NO: 965233 - DNA, 25 bp, Mus musculus
tttataattcaccactcagtagatg

SEQ ID NO: 965234 - DNA, 25 bp, Mus musculus
tttataattcacgactcagtagatg

SEQ ID NO: 965235 - DNA, 25 bp, Mus musculus
tttataattgttcggctaactgagg

SEQ ID NO: 965236 - DNA, 25 bp, Mus musculus
tttataattgttgggctaactgagg

SEQ ID NO: 965237 - DNA, 25 bp, Mus musculus
tttatacaataaagtcgctgcccaa

SEQ ID NO: 965238 - DNA, 25 bp, Mus musculus
tttatacaataatgtcgctgcccaa

SEQ ID NO: 965239 - DNA, 25 bp, Mus musculus
tttatacaatcaacccaacccttcg

SEQ ID NO: 965240 - DNA, 25 bp, Mus musculus
tttatacaatcatcccaacccttcg

SEQ ID NO: 965241 - DNA, 25 bp, Mus musculus
tttatacaggtaattcaattaaatg

SEQ ID NO: 965242 - DNA, 25 bp, Mus musculus
tttatacaggtatttcaattaaatg

SEQ ID NO: 965243 - DNA, 25 bp, Mus musculus
tttatacagtggatagactcagaat

SEQ ID NO: 965244 - DNA, 25 bp, Mus musculus
tttatacagtggttagactcagaat

SEQ ID NO: 965245 - DNA, 25 bp, Mus musculus
tttatacatccgagacagcgtttat

SEQ ID NO: 965246 - DNA, 25 bp, Mus musculus
tttatacatccgattttaatgactt

SEQ ID NO: 965247 - DNA, 25 bp, Mus musculus
tttatacatccgtgacagcgtttat

SEQ ID NO: 965248 - DNA, 25 bp, Mus musculus
tttatacatccgtttttaatgactt

SEQ ID NO: 965249 - DNA, 25 bp, Mus musculus
tttatacatttccagaccactcatc

SEQ ID NO: 965250 - DNA, 25 bp, Mus musculus
tttatacatttcgagaccactcatc

SEQ ID NO: 965251 - DNA, 25 bp, Mus musculus
tttataccagtaacgctaagcttta

SEQ ID NO: 965252 - DNA, 25 bp, Mus musculus
tttataccagtatcgctaagcttta

SEQ ID NO: 965253 - DNA, 25 bp, Mus musculus
tttataccccttcagacaaagaagt

SEQ ID NO: 965254 - DNA, 25 bp, Mus musculus
tttataccccttgagacaaagaagt

SEQ ID NO: 965255 - DNA, 25 bp, Mus musculus
tttatacccgatatcatctgagagg

SEQ ID NO: 965256 - DNA, 25 bp, Mus musculus
tttatacccgatttcatctgagagg

SEQ ID NO: 965257 - DNA, 25 bp, Mus musculus
tttataccctacaaccaaagctgga

SEQ ID NO: 965258 - DNA, 25 bp, Mus musculus
tttataccctactaccaaagctgga

SEQ ID NO: 965259 - DNA, 25 bp, Mus musculus
tttatacctcttactaatgtcccac

SEQ ID NO: 965260 - DNA, 25 bp, Mus musculus
tttatacctctttctaatgtcccac

SEQ ID NO: 965261 - DNA, 25 bp, Mus musculus
tttatacctggtacagctgccaaat

SEQ ID NO: 965262 - DNA, 25 bp, Mus musculus
tttatacctggttcagctgccaaat

SEQ ID NO: 965263 - DNA, 25 bp, Mus musculus
tttatacctgtacggaaactccctg

SEQ ID NO: 965264 - DNA, 25 bp, Mus musculus
tttatacctgtagggaaactccctg

SEQ ID NO: 965265 - DNA, 25 bp, Mus musculus
tttatacggtgtaggtgcccggcac

SEQ ID NO: 965266 - DNA, 25 bp, Mus musculus
tttatacggtgttggtgcccggcac

SEQ ID NO: 965267 - DNA, 25 bp, Mus musculus
tttatactatttcttctcttccacc

SEQ ID NO: 965268 - DNA, 25 bp, Mus musculus
tttatactatttgttctcttccacc

SEQ ID NO: 965269 - DNA, 25 bp, Mus musculus
tttatactcaaaatacataggctat

SEQ ID NO: 965270 - DNA, 25 bp, Mus musculus
tttatactcaaattacataggctat

SEQ ID NO: 965271 - DNA, 25 bp, Mus musculus
tttatactcattccttctgggcatg

SEQ ID NO: 965272 - DNA, 25 bp, Mus musculus
tttatactcattgcttctgggcatg

SEQ ID NO: 965273 - DNA, 25 bp, Mus musculus
tttatactcctacttacccattctt

SEQ ID NO: 965274 - DNA, 25 bp, Mus musculus
tttatactcctagttacccattctt

SEQ ID NO: 965275 - DNA, 25 bp, Mus musculus
tttatactcctgacggtacccacgt

SEQ ID NO: 965276 - DNA, 25 bp, Mus musculus
tttatactcctgtcggtacccacgt

SEQ ID NO: 965277 - DNA, 25 bp, Mus musculus
tttatactggagagggtagcattcc

SEQ ID NO: 965278 - DNA, 25 bp, Mus musculus
tttatactggagtgggtagcattcc

SEQ ID NO: 965279 - DNA, 25 bp, Mus musculus
tttatacttaacaccttccatcagc

SEQ ID NO: 965280 - DNA, 25 bp, Mus musculus
tttatacttaactccttccatcagc

SEQ ID NO: 965281 - DNA, 25 bp, Mus musculus
tttatagaacctaggccatggccag

SEQ ID NO: 965282 - DNA, 25 bp, Mus musculus
tttatagaaccttggccatggccag

SEQ ID NO: 965283 - DNA, 25 bp, Mus musculus
tttatagcagagacacctttccagg

SEQ ID NO: 965284 - DNA, 25 bp, Mus musculus
tttatagcagagtcacctttccagg

SEQ ID NO: 965285 - DNA, 25 bp, Mus musculus
tttatagcccagattcctttcatgg

SEQ ID NO: 965286 - DNA, 25 bp, Mus musculus
tttatagcccagtttcctttcatgg

SEQ ID NO: 965287 - DNA, 25 bp, Mus musculus
tttatagcgggcaagagagttccat

SEQ ID NO: 965288 - DNA, 25 bp, Mus musculus
tttatagcgggctagagagttccat

SEQ ID NO: 965289 - DNA, 25 bp, Mus musculus
tttatagctatcagacggctggata

SEQ ID NO: 965290 - DNA, 25 bp, Mus musculus
tttatagctatctgacggctggata

SEQ ID NO: 965291 - DNA, 25 bp, Mus musculus
tttatagctgctacctggttatcac

SEQ ID NO: 965292 - DNA, 25 bp, Mus musculus
tttatagctgcttcctggttatcac

SEQ ID NO: 965293 - DNA, 25 bp, Mus musculus
tttatagctggtaccgagatccctg

SEQ ID NO: 965294 - DNA, 25 bp, Mus musculus
tttatagctggttccgagatccctg

SEQ ID NO: 965295 - DNA, 25 bp, Mus musculus
tttataggaactcccaaatgtgcca

SEQ ID NO: 965296 - DNA, 25 bp, Mus musculus
tttataggaactgccaaatgtgcca

SEQ ID NO: 965297 - DNA, 25 bp, Mus musculus
tttatagtacttagccataacaggc

SEQ ID NO: 965298 - DNA, 25 bp, Mus musculus
tttatagtactttgccataacaggc

SEQ ID NO: 965299 - DNA, 25 bp, Mus musculus
tttatagtccccaggctactttctc

SEQ ID NO: 965300 - DNA, 25 bp, Mus musculus
tttatagtcccctggctactttctc

SEQ ID NO: 965301 - DNA, 25 bp, Mus musculus
tttatagtgacaactgacccacaga

SEQ ID NO: 965302 - DNA, 25 bp, Mus musculus
tttatagtgacatctgacccacaga

SEQ ID NO: 965303 - DNA, 25 bp, Mus musculus
tttatagtgactattttcccataca

SEQ ID NO: 965304 - DNA, 25 bp, Mus musculus
tttatagtgacttttttcccataca

SEQ ID NO: 965305 - DNA, 25 bp, Mus musculus
tttatagtgcatcccaaattttggg

SEQ ID NO: 965306 - DNA, 25 bp, Mus musculus
tttatagtgcatgccaaattttggg

SEQ ID NO: 965307 - DNA, 25 bp, Mus musculus
tttatagttccaccagcatcatgtc

SEQ ID NO: 965308 - DNA, 25 bp, Mus musculus
tttatagttccagcagcatcatgtc

SEQ ID NO: 965309 - DNA, 25 bp, Mus musculus
tttatagttctgatggatctgttca

SEQ ID NO: 965310 - DNA, 25 bp, Mus musculus
tttatagttctgttggatctgttca

SEQ ID NO: 965311 - DNA, 25 bp, Mus musculus
tttatataagctctcgtcttgcccc

SEQ ID NO: 965312 - DNA, 25 bp, Mus musculus
tttatataagctgtcgtcttgcccc

SEQ ID NO: 965313 - DNA, 25 bp, Mus musculus
tttatatacactcgctgtagcatac

SEQ ID NO: 965314 - DNA, 25 bp, Mus musculus
tttatatacactggctgtagcatac

SEQ ID NO: 965315 - DNA, 25 bp, Mus musculus
tttatatacatgaggccagtgcttg

SEQ ID NO: 965316 - DNA, 25 bp, Mus musculus
tttatatacatgtggccagtgcttg

SEQ ID NO: 965317 - DNA, 25 bp, Mus musculus
tttatataccacacttcctctttgt

SEQ ID NO: 965318 - DNA, 25 bp, Mus musculus
tttatataccactcttcctctttgt

SEQ ID NO: 965319 - DNA, 25 bp, Mus musculus
tttatatactacatgtgaaatgtcc

SEQ ID NO: 965320 - DNA, 25 bp, Mus musculus
tttatatactacttgtgaaatgtcc

SEQ ID NO: 965321 - DNA, 25 bp, Mus musculus
tttatatacttcctccgggtctcta

SEQ ID NO: 965322 - DNA, 25 bp, Mus musculus
tttatatacttcgtccgggtctcta

SEQ ID NO: 965323 - DNA, 25 bp, Mus musculus
tttatatagagacccctcggagcgg

SEQ ID NO: 965324 - DNA, 25 bp, Mus musculus
tttatatagagagccctcggagcgg

SEQ ID NO: 965325 - DNA, 25 bp, Mus musculus
tttatatatatacacctgccctggg

SEQ ID NO: 965326 - DNA, 25 bp, Mus musculus
tttatatatatagacctgccctggg

SEQ ID NO: 965327 - DNA, 25 bp, Mus musculus
tttatatatcggcttgtcatctttc

SEQ ID NO: 965328 - DNA, 25 bp, Mus musculus
tttatatatcgggttgtcatctttc

SEQ ID NO: 965329 - DNA, 25 bp, Mus musculus
tttatatcataaaggcgggtgctca

SEQ ID NO: 965330 - DNA, 25 bp, Mus musculus
tttatatcataatggcgggtgctca

SEQ ID NO: 965331 - DNA, 25 bp, Mus musculus
tttatatccattcctgtgtgccttg

SEQ ID NO: 965332 - DNA, 25 bp, Mus musculus
tttatatccattgctgtgtgccttg

SEQ ID NO: 965333 - DNA, 25 bp, Mus musculus
tttatatcgtaaacattcctcaggt

SEQ ID NO: 965334 - DNA, 25 bp, Mus musculus
tttatatcgtaatcattcctcaggt

SEQ ID NO: 965335 - DNA, 25 bp, Mus musculus
tttatatgccctcaatcgtgactcc

SEQ ID NO: 965336 - DNA, 25 bp, Mus musculus
tttatatgccctgaatcgtgactcc

SEQ ID NO: 965337 - DNA, 25 bp, Mus musculus
tttatatgtgcaaggagtcctggcc

SEQ ID NO: 965338 - DNA, 25 bp, Mus musculus
tttatatgtgcatggagtcctggcc

SEQ ID NO: 965339 - DNA, 25 bp, Mus musculus
tttatatgtgtgatccctggtggtg

SEQ ID NO: 965340 - DNA, 25 bp, Mus musculus
tttatatgtgtgttccctggtggtg

SEQ ID NO: 965341 - DNA, 25 bp, Mus musculus
tttatatgttatcttttatacccag

SEQ ID NO: 965342 - DNA, 25 bp, Mus musculus
tttatatgttatgttttatacccag

SEQ ID NO: 965343 - DNA, 25 bp, Mus musculus
tttatattccctacctgatcctact

SEQ ID NO: 965344 - DNA, 25 bp, Mus musculus
tttatattcccttcctgatcctact

SEQ ID NO: 965345 - DNA, 25 bp, Mus musculus
tttatattcgaaacgcttggagtca

SEQ ID NO: 965346 - DNA, 25 bp, Mus musculus
tttatattcgaatcgcttggagtca

SEQ ID NO: 965347 - DNA, 25 bp, Mus musculus
tttatattgaacattgggctgggaa

SEQ ID NO: 965348 - DNA, 25 bp, Mus musculus
tttatattgaactttgggctgggaa

SEQ ID NO: 965349 - DNA, 25 bp, Mus musculus
tttatattgataacttgctcacagt

SEQ ID NO: 965350 - DNA, 25 bp, Mus musculus
tttatattgatatcttgctcacagt

SEQ ID NO: 965351 - DNA, 25 bp, Mus musculus
tttatatttatacatgcctacaagg

SEQ ID NO: 965352 - DNA, 25 bp, Mus musculus
tttatatttatagatgcctacaagg

SEQ ID NO: 965353 - DNA, 25 bp, Mus musculus
tttatatttgcgctcttctgacagg

SEQ ID NO: 965354 - DNA, 25 bp, Mus musculus
tttatatttgcggtcttctgacagg

SEQ ID NO: 965355 - DNA, 25 bp, Mus musculus
tttatcaaaagcagggcccctttca

SEQ ID NO: 965356 - DNA, 25 bp, Mus musculus
tttatcaaaagctgggcccctttca

SEQ ID NO: 965357 - DNA, 25 bp, Mus musculus
tttatcaaatgcattaccccaggct

SEQ ID NO: 965358 - DNA, 25 bp, Mus musculus
tttatcaaatgctttaccccaggct

SEQ ID NO: 965359 - DNA, 25 bp, Mus musculus
tttatcaactaactcccgtttagag

SEQ ID NO: 965360 - DNA, 25 bp, Mus musculus
tttatcaactaagtcccgtttagag

SEQ ID NO: 965361 - DNA, 25 bp, Mus musculus
tttatcaagactcttcaaactctac

SEQ ID NO: 965362 - DNA, 25 bp, Mus musculus
tttatcaagactgttcaaactctac

SEQ ID NO: 965363 - DNA, 25 bp, Mus musculus
tttatcaagtatatccttctccggc

SEQ ID NO: 965364 - DNA, 25 bp, Mus musculus
tttatcaagtatttccttctccggc

SEQ ID NO: 965365 - DNA, 25 bp, Mus musculus
tttatcacacttaaaaggccaaggg

SEQ ID NO: 965366 - DNA, 25 bp, Mus musculus
tttatcacactttaaaggccaaggg

SEQ ID NO: 965367 - DNA, 25 bp, Mus musculus
tttatcacatacatagccccttagc

SEQ ID NO: 965368 - DNA, 25 bp, Mus musculus
tttatcacataccttttcttctgga

SEQ ID NO: 965369 - DNA, 25 bp, Mus musculus
tttatcacatacgttttcttctgga

SEQ ID NO: 965370 - DNA, 25 bp, Mus musculus
tttatcacatacttagccccttagc

SEQ ID NO: 965371 - DNA, 25 bp, Mus musculus
tttatcaccagtattttgagccatg

SEQ ID NO: 965372 - DNA, 25 bp, Mus musculus
tttatcaccagttttttgagccatg

SEQ ID NO: 965373 - DNA, 25 bp, Mus musculus
tttatcaccatgagcccacttaaca

SEQ ID NO: 965374 - DNA, 25 bp, Mus musculus
tttatcaccatgtgcccacttaaca

SEQ ID NO: 965375 - DNA, 25 bp, Mus musculus
tttatcacccacattcttctgaagg

SEQ ID NO: 965376 - DNA, 25 bp, Mus musculus
tttatcacccactttcttctgaagg

SEQ ID NO: 965377 - DNA, 25 bp, Mus musculus
tttatcacccagagtaacctacaag

SEQ ID NO: 965378 - DNA, 25 bp, Mus musculus
tttatcacccagctgtccggcctga

SEQ ID NO: 965379 - DNA, 25 bp, Mus musculus
tttatcacccaggtgtccggcctga

SEQ ID NO: 965380 - DNA, 25 bp, Mus musculus
tttatcacccagtgtaacctacaag

SEQ ID NO: 965381 - DNA, 25 bp, Mus musculus
tttatcacccttcacgtggttttgg

SEQ ID NO: 965382 - DNA, 25 bp, Mus musculus
tttatcacccttgacgtggttttgg

SEQ ID NO: 965383 - DNA, 25 bp, Mus musculus
tttatcactgccacagagtatataa

SEQ ID NO: 965384 - DNA, 25 bp, Mus musculus
tttatcactgcctcagagtatataa

SEQ ID NO: 965385 - DNA, 25 bp, Mus musculus
tttatcactgtaaccacaactcctt

SEQ ID NO: 965386 - DNA, 25 bp, Mus musculus
tttatcactgtatccacaactcctt

SEQ ID NO: 965387 - DNA, 25 bp, Mus musculus
tttatcacttctcacaacctggatg

SEQ ID NO: 965388 - DNA, 25 bp, Mus musculus
tttatcacttctgacaacctggatg

SEQ ID NO: 965389 - DNA, 25 bp, Mus musculus
tttatcacttgcaagatgctaccag

SEQ ID NO: 965390 - DNA, 25 bp, Mus musculus
tttatcacttgctagatgctaccag

SEQ ID NO: 965391 - DNA, 25 bp, Mus musculus
tttatcagagtgcaccagaccagaa

SEQ ID NO: 965392 - DNA, 25 bp, Mus musculus
tttatcagagtggaccagaccagaa

SEQ ID NO: 965393 - DNA, 25 bp, Mus musculus
tttatcagcagcattccaccattga

SEQ ID NO: 965394 - DNA, 25 bp, Mus musculus
tttatcagcagctttccaccattga

SEQ ID NO: 965395 - DNA, 25 bp, Mus musculus
tttatcagctacctgctagcagctt

SEQ ID NO: 965396 - DNA, 25 bp, Mus musculus
tttatcagctacgtgctagcagctt

SEQ ID NO: 965397 - DNA, 25 bp, Mus musculus
tttatcagcttgacaatgtcaactc

SEQ ID NO: 965398 - DNA, 25 bp, Mus musculus
tttatcagcttgtcaatgtcaactc

SEQ ID NO: 965399 - DNA, 25 bp, Mus musculus
tttatcaggcgtcgcaggaagttgc

SEQ ID NO: 965400 - DNA, 25 bp, Mus musculus
tttatcaggcgtggcaggaagttgc

SEQ ID NO: 965401 - DNA, 25 bp, Mus musculus
tttatcagtggcaactatttaccag

SEQ ID NO: 965402 - DNA, 25 bp, Mus musculus
tttatcagtggctactatttaccag

SEQ ID NO: 965403 - DNA, 25 bp, Mus musculus
tttatcagtgtcatttgctcttccc

SEQ ID NO: 965404 - DNA, 25 bp, Mus musculus
tttatcagtgtcttttgctcttccc

SEQ ID NO: 965405 - DNA, 25 bp, Mus musculus
tttatcatagaacgccctccacctt

SEQ ID NO: 965406 - DNA, 25 bp, Mus musculus
tttatcatagaaggccctccacctt

SEQ ID NO: 965407 - DNA, 25 bp, Mus musculus
tttatcatccacaatgccttgtcac

SEQ ID NO: 965408 - DNA, 25 bp, Mus musculus
tttatcatccactatgccttgtcac

SEQ ID NO: 965409 - DNA, 25 bp, Mus musculus
tttatcatgatccaatttacaattg

SEQ ID NO: 965410 - DNA, 25 bp, Mus musculus
tttatcatgatcgaatttacaattg

SEQ ID NO: 965411 - DNA, 25 bp, Mus musculus
tttatcatgcccaaatgccagattc

SEQ ID NO: 965412 - DNA, 25 bp, Mus musculus
tttatcatgccctaatgccagattc

SEQ ID NO: 965413 - DNA, 25 bp, Mus musculus
tttatcatggcaactggcagagagc

SEQ ID NO: 965414 - DNA, 25 bp, Mus musculus
tttatcatggcatctggcagagagc

SEQ ID NO: 965415 - DNA, 25 bp, Mus musculus
tttatcatggctactgtcaaactgc

SEQ ID NO: 965416 - DNA, 25 bp, Mus musculus
tttatcatggcttctgtcaaactgc

SEQ ID NO: 965417 - DNA, 25 bp, Mus musculus
tttatcatgtgacggtattgggaaa

SEQ ID NO: 965418 - DNA, 25 bp, Mus musculus
tttatcatgtgagggtattgggaaa

SEQ ID NO: 965419 - DNA, 25 bp, Mus musculus
tttatcattgacacttgtggtgtga

SEQ ID NO: 965420 - DNA, 25 bp, Mus musculus
tttatcattgactcttgtggtgtga

SEQ ID NO: 965421 - DNA, 25 bp, Mus musculus
tttatcattgggacggccacccatg

SEQ ID NO: 965422 - DNA, 25 bp, Mus musculus
tttatcattgggtcggccacccatg

SEQ ID NO: 965423 - DNA, 25 bp, Mus musculus
tttatcatttggcattaacaccata

SEQ ID NO: 965424 - DNA, 25 bp, Mus musculus
tttatcatttgggattaacaccata

SEQ ID NO: 965425 - DNA, 25 bp, Mus musculus
tttatccaaaatctccccttagagg

SEQ ID NO: 965426 - DNA, 25 bp, Mus musculus
tttatccaaaatgtccccttagagg

SEQ ID NO: 965427 - DNA, 25 bp, Mus musculus
tttatccaaaccagtgtcatgcctg

SEQ ID NO: 965428 - DNA, 25 bp, Mus musculus
tttatccaaacctgtgtcatgcctg

SEQ ID NO: 965429 - DNA, 25 bp, Mus musculus
tttatccaacatccctatttcttcg

SEQ ID NO: 965430 - DNA, 25 bp, Mus musculus
tttatccaacatgcctatttcttcg

SEQ ID NO: 965431 - DNA, 25 bp, Mus musculus
tttatccaacttaaggcgctgctga

SEQ ID NO: 965432 - DNA, 25 bp, Mus musculus
tttatccaactttaggcgctgctga

SEQ ID NO: 965433 - DNA, 25 bp, Mus musculus
tttatccaatcccaaactacctgtt

SEQ ID NO: 965434 - DNA, 25 bp, Mus musculus
tttatccaatccgaaactacctgtt

SEQ ID NO: 965435 - DNA, 25 bp, Mus musculus
tttatccaatgcagacccctgatgt

SEQ ID NO: 965436 - DNA, 25 bp, Mus musculus
tttatccaatgctgacccctgatgt

SEQ ID NO: 965437 - DNA, 25 bp, Mus musculus
tttatccaatggcacgcagttatat

SEQ ID NO: 965438 - DNA, 25 bp, Mus musculus
tttatccaatgggacgcagttatat

SEQ ID NO: 965439 - DNA, 25 bp, Mus musculus
tttatccaccccacgaggacatggc

SEQ ID NO: 965440 - DNA, 25 bp, Mus musculus
tttatccacccctcgaggacatggc

SEQ ID NO: 965441 - DNA, 25 bp, Mus musculus
tttatccactggaactgttaactat

SEQ ID NO: 965442 - DNA, 25 bp, Mus musculus
tttatccactggagacctcgaggaa

SEQ ID NO: 965443 - DNA, 25 bp, Mus musculus
tttatccactggtactgttaactat

SEQ ID NO: 965444 - DNA, 25 bp, Mus musculus
tttatccactggtgacctcgaggaa

SEQ ID NO: 965445 - DNA, 25 bp, Mus musculus
tttatccagttcaagacgttctaag

SEQ ID NO: 965446 - DNA, 25 bp, Mus musculus
tttatccagttctagacgttctaag

SEQ ID NO: 965447 - DNA, 25 bp, Mus musculus
tttatccatagaattagttcctctt

SEQ ID NO: 965448 - DNA, 25 bp, Mus musculus
tttatccatagatttagttcctctt

SEQ ID NO: 965449 - DNA, 25 bp, Mus musculus
tttatccatcgaagcatctcaccag

SEQ ID NO: 965450 - DNA, 25 bp, Mus musculus
tttatccatcgatgcatctcaccag

SEQ ID NO: 965451 - DNA, 25 bp, Mus musculus
tttatccatgatcctgaaattcaga

SEQ ID NO: 965452 - DNA, 25 bp, Mus musculus
tttatccatgatgctgaaattcaga

SEQ ID NO: 965453 - DNA, 25 bp, Mus musculus
tttatccatgctccgatgaggccgg

SEQ ID NO: 965454 - DNA, 25 bp, Mus musculus
tttatccatgctgcgatgaggccgg

SEQ ID NO: 965455 - DNA, 25 bp, Mus musculus
tttatcccacacagttttccaggaa

SEQ ID NO: 965456 - DNA, 25 bp, Mus musculus
tttatcccacactgttttccaggaa

SEQ ID NO: 965457 - DNA, 25 bp, Mus musculus
tttatcccactcctaaacaacgtag

SEQ ID NO: 965458 - DNA, 25 bp, Mus musculus
tttatcccactcgtaaacaacgtag

SEQ ID NO: 965459 - DNA, 25 bp, Mus musculus
tttatcccagtgaaccaagtcaatt

SEQ ID NO: 965460 - DNA, 25 bp, Mus musculus
tttatcccagtgtaccaagtcaatt

SEQ ID NO: 965461 - DNA, 25 bp, Mus musculus
tttatcccccgacacagtgaagtgg

SEQ ID NO: 965462 - DNA, 25 bp, Mus musculus
tttatcccccgagacagtgaagtgg

SEQ ID NO: 965463 - DNA, 25 bp, Mus musculus
tttatccccgtgaggactttgtgat

SEQ ID NO: 965464 - DNA, 25 bp, Mus musculus
tttatccccgtgtggactttgtgat

SEQ ID NO: 965465 - DNA, 25 bp, Mus musculus
tttatcccctgcaatcacagatgat

SEQ ID NO: 965466 - DNA, 25 bp, Mus musculus
tttatcccctgctatcacagatgat

SEQ ID NO: 965467 - DNA, 25 bp, Mus musculus
tttatcccggtgagtctgtgtactt

SEQ ID NO: 965468 - DNA, 25 bp, Mus musculus
tttatcccggtgtgtctgtgtactt

SEQ ID NO: 965469 - DNA, 25 bp, Mus musculus
tttatccctagtcaccttcctggta

SEQ ID NO: 965470 - DNA, 25 bp, Mus musculus
tttatccctagtgaccttcctggta

SEQ ID NO: 965471 - DNA, 25 bp, Mus musculus
tttatcccttttatcatttgggatt

SEQ ID NO: 965472 - DNA, 25 bp, Mus musculus
tttatcccttttttcatttgggatt

SEQ ID NO: 965473 - DNA, 25 bp, Mus musculus
tttatccgaaacctcgtcacattgg

SEQ ID NO: 965474 - DNA, 25 bp, Mus musculus
tttatccgaaacgtcgtcacattgg

SEQ ID NO: 965475 - DNA, 25 bp, Mus musculus
tttatccgaatgacagcgttctctg

SEQ ID NO: 965476 - DNA, 25 bp, Mus musculus
tttatccgaatgtcagcgttctctg

SEQ ID NO: 965477 - DNA, 25 bp, Mus musculus
tttatccgcaccaggctacgagacc

SEQ ID NO: 965478 - DNA, 25 bp, Mus musculus
tttatccgcacctggctacgagacc

SEQ ID NO: 965479 - DNA, 25 bp, Mus musculus
tttatcctcaatctgaacccagttg

SEQ ID NO: 965480 - DNA, 25 bp, Mus musculus
tttatcctcaatgtgaacccagttg

SEQ ID NO: 965481 - DNA, 25 bp, Mus musculus
tttatcctctaaccgcatctcactg

SEQ ID NO: 965482 - DNA, 25 bp, Mus musculus
tttatcctctaagcgcatctcactg

SEQ ID NO: 965483 - DNA, 25 bp, Mus musculus
tttatcctctgtacaagggcaccag

SEQ ID NO: 965484 - DNA, 25 bp, Mus musculus
tttatcctctgttcaagggcaccag

SEQ ID NO: 965485 - DNA, 25 bp, Mus musculus
tttatcctcttccaagttcttttct

SEQ ID NO: 965486 - DNA, 25 bp, Mus musculus
tttatcctcttcgaagttcttttct

SEQ ID NO: 965487 - DNA, 25 bp, Mus musculus
tttatcctgacacactttggcatgg

SEQ ID NO: 965488 - DNA, 25 bp, Mus musculus
tttatcctgacagactttggcatgg

SEQ ID NO: 965489 - DNA, 25 bp, Mus musculus
tttatcctgagtcacccttctaaga

SEQ ID NO: 965490 - DNA, 25 bp, Mus musculus
tttatcctgagtgacccttctaaga

SEQ ID NO: 965491 - DNA, 25 bp, Mus musculus
tttatcctgcgtagacagagcaccg

SEQ ID NO: 965492 - DNA, 25 bp, Mus musculus
tttatcctgcgttgacagagcaccg

SEQ ID NO: 965493 - DNA, 25 bp, Mus musculus
tttatcctgctaatctattgaactg

SEQ ID NO: 965494 - DNA, 25 bp, Mus musculus
tttatcctgctattctattgaactg

SEQ ID NO: 965495 - DNA, 25 bp, Mus musculus
tttatcctggcaattatcctctggt

SEQ ID NO: 965496 - DNA, 25 bp, Mus musculus
tttatcctggcatttatcctctggt

SEQ ID NO: 965497 - DNA, 25 bp, Mus musculus
tttatcctggcccttccgtgaacga

SEQ ID NO: 965498 - DNA, 25 bp, Mus musculus
tttatcctggccgttccgtgaacga

SEQ ID NO: 965499 - DNA, 25 bp, Mus musculus
tttatcctgggaactggactctcac

SEQ ID NO: 965500 - DNA, 25 bp, Mus musculus
tttatcctgggatctggactctcac

SEQ ID NO: 965501 - DNA, 25 bp, Mus musculus
tttatcctgtgcactccgcagtggg

SEQ ID NO: 965502 - DNA, 25 bp, Mus musculus
tttatcctgtgctctccgcagtggg

SEQ ID NO: 965503 - DNA, 25 bp, Mus musculus
tttatccttaaaatctctggctctg

SEQ ID NO: 965504 - DNA, 25 bp, Mus musculus
tttatccttaaattctctggctctg

SEQ ID NO: 965505 - DNA, 25 bp, Mus musculus
tttatccttagcaatctactttttg

SEQ ID NO: 965506 - DNA, 25 bp, Mus musculus
tttatccttagctatctactttttg

SEQ ID NO: 965507 - DNA, 25 bp, Mus musculus
tttatccttctgctcatggagggtc

SEQ ID NO: 965508 - DNA, 25 bp, Mus musculus
tttatccttctggtcatggagggtc

SEQ ID NO: 965509 - DNA, 25 bp, Mus musculus
tttatcctttctagtgccctggctg

SEQ ID NO: 965510 - DNA, 25 bp, Mus musculus
tttatcctttctcaagtctgtctcg

SEQ ID NO: 965511 - DNA, 25 bp, Mus musculus
tttatcctttctgaagtctgtctcg

SEQ ID NO: 965512 - DNA, 25 bp, Mus musculus
tttatcctttcttgtgccctggctg

SEQ ID NO: 965513 - DNA, 25 bp, Mus musculus
tttatcgaagccagtgagatgcact

SEQ ID NO: 965514 - DNA, 25 bp, Mus musculus
tttatcgaagcccacgtgtactgaa

SEQ ID NO: 965515 - DNA, 25 bp, Mus musculus
tttatcgaagccgacgtgtactgaa

SEQ ID NO: 965516 - DNA, 25 bp, Mus musculus
tttatcgaagcctgtgagatgcact

SEQ ID NO: 965517 - DNA, 25 bp, Mus musculus
tttatcgaccccactggtgaggaat

SEQ ID NO: 965518 - DNA, 25 bp, Mus musculus
tttatcgacccctctggtgaggaat

SEQ ID NO: 965519 - DNA, 25 bp, Mus musculus
tttatcgaccgccacaaacagctgc

SEQ ID NO: 965520 - DNA, 25 bp, Mus musculus
tttatcgaccgcgacaaacagctgc

SEQ ID NO: 965521 - DNA, 25 bp, Mus musculus
tttatcgccatgacttaatcaatca

SEQ ID NO: 965522 - DNA, 25 bp, Mus musculus
tttatcgccatgtcttaatcaatca

SEQ ID NO: 965523 - DNA, 25 bp, Mus musculus
tttatcgtgtccctgtaccatattg

SEQ ID NO: 965524 - DNA, 25 bp, Mus musculus
tttatcgtgtccgtgtaccatattg

SEQ ID NO: 965525 - DNA, 25 bp, Mus musculus
tttatcgttccaagcttcatcttag

SEQ ID NO: 965526 - DNA, 25 bp, Mus musculus
tttatcgttccatgcttcatcttag

SEQ ID NO: 965527 - DNA, 25 bp, Mus musculus
tttatcgttcttatcattggacccg

SEQ ID NO: 965528 - DNA, 25 bp, Mus musculus
tttatcgttcttttcattggacccg

SEQ ID NO: 965529 - DNA, 25 bp, Mus musculus
tttatctaagcaacccaagtaacta

SEQ ID NO: 965530 - DNA, 25 bp, Mus musculus
tttatctaagcatcccaagtaacta

SEQ ID NO: 965531 - DNA, 25 bp, Mus musculus
tttatctaggccacatagctatgac

SEQ ID NO: 965532 - DNA, 25 bp, Mus musculus
tttatctaggcctcatagctatgac

SEQ ID NO: 965533 - DNA, 25 bp, Mus musculus
tttatctcagagctagtcagggctg

SEQ ID NO: 965534 - DNA, 25 bp, Mus musculus
tttatctcagaggtagtcagggctg

SEQ ID NO: 965535 - DNA, 25 bp, Mus musculus
tttatctcagcacgctagcctggtc

SEQ ID NO: 965536 - DNA, 25 bp, Mus musculus
tttatctcagcaggctagcctggtc

SEQ ID NO: 965537 - DNA, 25 bp, Mus musculus
tttatctcctcaactgtaagcagaa

SEQ ID NO: 965538 - DNA, 25 bp, Mus musculus
tttatctcctcatctgtaagcagaa

SEQ ID NO: 965539 - DNA, 25 bp, Mus musculus
tttatctctactccatgggccgaaa

SEQ ID NO: 965540 - DNA, 25 bp, Mus musculus
tttatctctactgcatgggccgaaa

SEQ ID NO: 965541 - DNA, 25 bp, Mus musculus
tttatctgatgtagactgggcccct

SEQ ID NO: 965542 - DNA, 25 bp, Mus musculus
tttatctgatgttgactgggcccct

SEQ ID NO: 965543 - DNA, 25 bp, Mus musculus
tttatctggcctactgataggatga

SEQ ID NO: 965544 - DNA, 25 bp, Mus musculus
tttatctggccttctgataggatga

SEQ ID NO: 965545 - DNA, 25 bp, Mus musculus
tttatctgtagcaccatcaccagtt

SEQ ID NO: 965546 - DNA, 25 bp, Mus musculus
tttatctgtagctccatcaccagtt

SEQ ID NO: 965547 - DNA, 25 bp, Mus musculus
tttatctgttgtagacccatctctc

SEQ ID NO: 965548 - DNA, 25 bp, Mus musculus
tttatctgttgttgacccatctctc

SEQ ID NO: 965549 - DNA, 25 bp, Mus musculus
tttatcttaaggcattcatgccaag

SEQ ID NO: 965550 - DNA, 25 bp, Mus musculus
tttatcttaagggattcatgccaag

SEQ ID NO: 965551 - DNA, 25 bp, Mus musculus
tttatcttcctcctctgcgttgtga

SEQ ID NO: 965552 - DNA, 25 bp, Mus musculus
tttatcttcctcgtctgcgttgtga

SEQ ID NO: 965553 - DNA, 25 bp, Mus musculus
tttatcttctctcctctacaggaag

SEQ ID NO: 965554 - DNA, 25 bp, Mus musculus
tttatcttctctgctctacaggaag

SEQ ID NO: 965555 - DNA, 25 bp, Mus musculus
tttatcttctgcagtgctgatggcc

SEQ ID NO: 965556 - DNA, 25 bp, Mus musculus
tttatcttctgctgtgctgatggcc

SEQ ID NO: 965557 - DNA, 25 bp, Mus musculus
tttatcttcttgctaaccgtggcct

SEQ ID NO: 965558 - DNA, 25 bp, Mus musculus
tttatcttcttggtaaccgtggcct

SEQ ID NO: 965559 - DNA, 25 bp, Mus musculus
tttatctttaagacagctccagctg

SEQ ID NO: 965560 - DNA, 25 bp, Mus musculus
tttatctttaagtcagctccagctg

SEQ ID NO: 965561 - DNA, 25 bp, Mus musculus
tttatctttattccaaaccaccaat

SEQ ID NO: 965562 - DNA, 25 bp, Mus musculus
tttatctttattgcaaaccaccaat

SEQ ID NO: 965563 - DNA, 25 bp, Mus musculus
tttatctttcggatctgatttccat

SEQ ID NO: 965564 - DNA, 25 bp, Mus musculus
tttatctttcggttctgatttccat

SEQ ID NO: 965565 - DNA, 25 bp, Mus musculus
tttatctttgcaactctaggcgcaa

SEQ ID NO: 965566 - DNA, 25 bp, Mus musculus
tttatctttgcatctctaggcgcaa

SEQ ID NO: 965567 - DNA, 25 bp, Mus musculus
tttatctttgccaacaatctcccta

SEQ ID NO: 965568 - DNA, 25 bp, Mus musculus
tttatctttgcccaggattccgatg

SEQ ID NO: 965569 - DNA, 25 bp, Mus musculus
tttatctttgccgaggattccgatg

SEQ ID NO: 965570 - DNA, 25 bp, Mus musculus
tttatctttgcctacaatctcccta

SEQ ID NO: 965571 - DNA, 25 bp, Mus musculus
tttatctttgtcacccaagtctgta

SEQ ID NO: 965572 - DNA, 25 bp, Mus musculus
tttatctttgtctcccaagtctgta

SEQ ID NO: 965573 - DNA, 25 bp, Mus musculus
tttatctttgttcaggaccttgtgc

SEQ ID NO: 965574 - DNA, 25 bp, Mus musculus
tttatctttgttgaggaccttgtgc

SEQ ID NO: 965575 - DNA, 25 bp, Mus musculus
tttatcttttacaatgggagtcact

SEQ ID NO: 965576 - DNA, 25 bp, Mus musculus
tttatcttttactatgggagtcact

SEQ ID NO: 965577 - DNA, 25 bp, Mus musculus
tttatcttttccacttccgctaaat

SEQ ID NO: 965578 - DNA, 25 bp, Mus musculus
tttatcttttcctcttccgctaaat

SEQ ID NO: 965579 - DNA, 25 bp, Mus musculus
tttatcttttgcatggtttgtcagg

SEQ ID NO: 965580 - DNA, 25 bp, Mus musculus
tttatcttttgcttggtttgtcagg

SEQ ID NO: 965581 - DNA, 25 bp, Mus musculus
tttatgaacctccttgcccaattct

SEQ ID NO: 965582 - DNA, 25 bp, Mus musculus
tttatgaacctcgttgcccaattct

SEQ ID NO: 965583 - DNA, 25 bp, Mus musculus
tttatgaagggtatgacaaccagac

SEQ ID NO: 965584 - DNA, 25 bp, Mus musculus
tttatgaagggtttgacaaccagac

SEQ ID NO: 965585 - DNA, 25 bp, Mus musculus
tttatgaaggtgaggcatgccccgt

SEQ ID NO: 965586 - DNA, 25 bp, Mus musculus
tttatgaaggtgtggcatgccccgt

SEQ ID NO: 965587 - DNA, 25 bp, Mus musculus
tttatgacaattccactcttggccc

SEQ ID NO: 965588 - DNA, 25 bp, Mus musculus
tttatgacaattgcactcttggccc

SEQ ID NO: 965589 - DNA, 25 bp, Mus musculus
tttatgacaccgacaaccttcttag

SEQ ID NO: 965590 - DNA, 25 bp, Mus musculus
tttatgacaccgtcaaccttcttag

SEQ ID NO: 965591 - DNA, 25 bp, Mus musculus
tttatgacagatcttacgccttcct

SEQ ID NO: 965592 - DNA, 25 bp, Mus musculus
tttatgacagatgttacgccttcct

SEQ ID NO: 965593 - DNA, 25 bp, Mus musculus
tttatgacgttcctcatatcctccg

SEQ ID NO: 965594 - DNA, 25 bp, Mus musculus
tttatgacgttcgtcatatcctccg

SEQ ID NO: 965595 - DNA, 25 bp, Mus musculus
tttatgagataccttcgcagcctgt

SEQ ID NO: 965596 - DNA, 25 bp, Mus musculus
tttatgagatacgttcgcagcctgt

SEQ ID NO: 965597 - DNA, 25 bp, Mus musculus
tttatgagcccaaccttgcggttcc

SEQ ID NO: 965598 - DNA, 25 bp, Mus musculus
tttatgagcccatccttgcggttcc

SEQ ID NO: 965599 - DNA, 25 bp, Mus musculus
tttatgagccttcagacttctctct

SEQ ID NO: 965600 - DNA, 25 bp, Mus musculus
tttatgagccttgagacttctctct

SEQ ID NO: 965601 - DNA, 25 bp, Mus musculus
tttatgaggcagaacctggtcctga

SEQ ID NO: 965602 - DNA, 25 bp, Mus musculus
tttatgaggcagtacctggtcctga

SEQ ID NO: 965603 - DNA, 25 bp, Mus musculus
tttatgaggtgtacgtccttgcctg

SEQ ID NO: 965604 - DNA, 25 bp, Mus musculus
tttatgaggtgttcgtccttgcctg

SEQ ID NO: 965605 - DNA, 25 bp, Mus musculus
tttatgatagatatgactgcttttc

SEQ ID NO: 965606 - DNA, 25 bp, Mus musculus
tttatgatagatttgactgcttttc

SEQ ID NO: 965607 - DNA, 25 bp, Mus musculus
tttatgatcggcatacccaatgttg

SEQ ID NO: 965608 - DNA, 25 bp, Mus musculus
tttatgatcggcttacccaatgttg

SEQ ID NO: 965609 - DNA, 25 bp, Mus musculus
tttatgatgcccctgagtatgatgc

SEQ ID NO: 965610 - DNA, 25 bp, Mus musculus
tttatgatgcccgtgagtatgatgc

SEQ ID NO: 965611 - DNA, 25 bp, Mus musculus
tttatgatggtcaccacctccactc

SEQ ID NO: 965612 - DNA, 25 bp, Mus musculus
tttatgatggtctccacctccactc

SEQ ID NO: 965613 - DNA, 25 bp, Mus musculus
tttatgatgtccattgtggtggccc

SEQ ID NO: 965614 - DNA, 25 bp, Mus musculus
tttatgatgtcctttgtggtggccc

SEQ ID NO: 965615 - DNA, 25 bp, Mus musculus
tttatgattcatatgcctgtttgtt

SEQ ID NO: 965616 - DNA, 25 bp, Mus musculus
tttatgattcatttgcctgtttgtt

SEQ ID NO: 965617 - DNA, 25 bp, Mus musculus
tttatgcaaaatcgccctatgctgc

SEQ ID NO: 965618 - DNA, 25 bp, Mus musculus
tttatgcaaaatggccctatgctgc

SEQ ID NO: 965619 - DNA, 25 bp, Mus musculus
tttatgcaaactcggcgtgagcctc

SEQ ID NO: 965620 - DNA, 25 bp, Mus musculus
tttatgcaaactgggcgtgagcctc

SEQ ID NO: 965621 - DNA, 25 bp, Mus musculus
tttatgcaccagatatgctaacggg

SEQ ID NO: 965622 - DNA, 25 bp, Mus musculus
tttatgcaccagttatgctaacggg

SEQ ID NO: 965623 - DNA, 25 bp, Mus musculus
tttatgcacgcacacaagtttcttg

SEQ ID NO: 965624 - DNA, 25 bp, Mus musculus
tttatgcacgcagacaagtttcttg

SEQ ID NO: 965625 - DNA, 25 bp, Mus musculus
tttatgcagacacaccctccctcac

SEQ ID NO: 965626 - DNA, 25 bp, Mus musculus
tttatgcagacagaccctccctcac

SEQ ID NO: 965627 - DNA, 25 bp, Mus musculus
tttatgcagcatcaggtgcccacat

SEQ ID NO: 965628 - DNA, 25 bp, Mus musculus
tttatgcagcatgaggtgcccacat

SEQ ID NO: 965629 - DNA, 25 bp, Mus musculus
tttatgcagctgctaccacagtact

SEQ ID NO: 965630 - DNA, 25 bp, Mus musculus
tttatgcagctggtaccacagtact

SEQ ID NO: 965631 - DNA, 25 bp, Mus musculus
tttatgcagtggaccccatgggaac

SEQ ID NO: 965632 - DNA, 25 bp, Mus musculus
tttatgcagtggtccccatgggaac

SEQ ID NO: 965633 - DNA, 25 bp, Mus musculus
tttatgcatcctcagccgttcttca

SEQ ID NO: 965634 - DNA, 25 bp, Mus musculus
tttatgcatcctgagccgttcttca

SEQ ID NO: 965635 - DNA, 25 bp, Mus musculus
tttatgcatttcaatatcgcctccc

SEQ ID NO: 965636 - DNA, 25 bp, Mus musculus
tttatgcatttctatatcgcctccc

SEQ ID NO: 965637 - DNA, 25 bp, Mus musculus
tttatgccaaggcaagggcttgctc

SEQ ID NO: 965638 - DNA, 25 bp, Mus musculus
tttatgccaagggaagggcttgctc

SEQ ID NO: 965639 - DNA, 25 bp, Mus musculus
tttatgccacaaaagggcctcagag

SEQ ID NO: 965640 - DNA, 25 bp, Mus musculus
tttatgccacaatagggcctcagag

SEQ ID NO: 965641 - DNA, 25 bp, Mus musculus
tttatgccaccgcttgatgatcctg

SEQ ID NO: 965642 - DNA, 25 bp, Mus musculus
tttatgccaccggttgatgatcctg

SEQ ID NO: 965643 - DNA, 25 bp, Mus musculus
tttatgccaggcaaggatttgtatg

SEQ ID NO: 965644 - DNA, 25 bp, Mus musculus
tttatgccaggctaggatttgtatg

SEQ ID NO: 965645 - DNA, 25 bp, Mus musculus
tttatgccatgcagtcctgtttgtc

SEQ ID NO: 965646 - DNA, 25 bp, Mus musculus
tttatgccatgctgtcctgtttgtc

SEQ ID NO: 965647 - DNA, 25 bp, Mus musculus
tttatgccccaacaaaatccactgt

SEQ ID NO: 965648 - DNA, 25 bp, Mus musculus
tttatgccccaagaaaatccactgt

SEQ ID NO: 965649 - DNA, 25 bp, Mus musculus
tttatgcccgtgaattttcacattt

SEQ ID NO: 965650 - DNA, 25 bp, Mus musculus
tttatgcccgtgtattttcacattt

SEQ ID NO: 965651 - DNA, 25 bp, Mus musculus
tttatgccctttcaacatgtccctt

SEQ ID NO: 965652 - DNA, 25 bp, Mus musculus
tttatgccctttgaacatgtccctt

SEQ ID NO: 965653 - DNA, 25 bp, Mus musculus
tttatgcctaacaccaagacagact

SEQ ID NO: 965654 - DNA, 25 bp, Mus musculus
tttatgcctaactccaagacagact

SEQ ID NO: 965655 - DNA, 25 bp, Mus musculus
tttatgcctcaaagaatcccatcat

SEQ ID NO: 965656 - DNA, 25 bp, Mus musculus
tttatgcctcaatgaatcccatcat

SEQ ID NO: 965657 - DNA, 25 bp, Mus musculus
tttatgccttgaaattcctctttgt

SEQ ID NO: 965658 - DNA, 25 bp, Mus musculus
tttatgccttgatattcctctttgt

SEQ ID NO: 965659 - DNA, 25 bp, Mus musculus
tttatgcgagtgcacacagggtatt

SEQ ID NO: 965660 - DNA, 25 bp, Mus musculus
tttatgcgagtggacacagggtatt

SEQ ID NO: 965661 - DNA, 25 bp, Mus musculus
tttatgcggcagctgcaacttgccc

SEQ ID NO: 965662 - DNA, 25 bp, Mus musculus
tttatgcggcaggtgcaacttgccc

SEQ ID NO: 965663 - DNA, 25 bp, Mus musculus
tttatgcggttcagaagcccttttc

SEQ ID NO: 965664 - DNA, 25 bp, Mus musculus
tttatgcggttctgaagcccttttc

SEQ ID NO: 965665 - DNA, 25 bp, Mus musculus
tttatgctaatccacatttgccacc

SEQ ID NO: 965666 - DNA, 25 bp, Mus musculus
tttatgctaatcgacatttgccacc

SEQ ID NO: 965667 - DNA, 25 bp, Mus musculus
tttatgctcaagaaaatggctaggc

SEQ ID NO: 965668 - DNA, 25 bp, Mus musculus
tttatgctcaagctcatggttgtcc

SEQ ID NO: 965669 - DNA, 25 bp, Mus musculus
tttatgctcaaggtcatggttgtcc

SEQ ID NO: 965670 - DNA, 25 bp, Mus musculus
tttatgctcaagtaaatggctaggc

SEQ ID NO: 965671 - DNA, 25 bp, Mus musculus
tttatgctctccattcattttggga

SEQ ID NO: 965672 - DNA, 25 bp, Mus musculus
tttatgctctcctttcattttggga

SEQ ID NO: 965673 - DNA, 25 bp, Mus musculus
tttatgctctgacttgctcctgggt

SEQ ID NO: 965674 - DNA, 25 bp, Mus musculus
tttatgctctgagttgctcctgggt

SEQ ID NO: 965675 - DNA, 25 bp, Mus musculus
tttatgctgccaaagtaactcgccc

SEQ ID NO: 965676 - DNA, 25 bp, Mus musculus
tttatgctgccatagtaactcgccc

SEQ ID NO: 965677 - DNA, 25 bp, Mus musculus
tttatgctgcttccctacgagtgtg

SEQ ID NO: 965678 - DNA, 25 bp, Mus musculus
tttatgctgcttgcctacgagtgtg

SEQ ID NO: 965679 - DNA, 25 bp, Mus musculus
tttatgctggagctggcctagacac

SEQ ID NO: 965680 - DNA, 25 bp, Mus musculus
tttatgctggaggtggcctagacac

SEQ ID NO: 965681 - DNA, 25 bp, Mus musculus
tttatgctgtccctaaaatctgaga

SEQ ID NO: 965682 - DNA, 25 bp, Mus musculus
tttatgctgtccgtaaaatctgaga

SEQ ID NO: 965683 - DNA, 25 bp, Mus musculus
tttatgctgtctagacagttgggcc

SEQ ID NO: 965684 - DNA, 25 bp, Mus musculus
tttatgctgtcttgacagttgggcc

SEQ ID NO: 965685 - DNA, 25 bp, Mus musculus
tttatgctgtgaccaaaggaccaag

SEQ ID NO: 965686 - DNA, 25 bp, Mus musculus
tttatgctgtgagcaaaggaccaag

SEQ ID NO: 965687 - DNA, 25 bp, Mus musculus
tttatgcttaccaaggcctaacctg

SEQ ID NO: 965688 - DNA, 25 bp, Mus musculus
tttatgcttacctaggcctaacctg

SEQ ID NO: 965689 - DNA, 25 bp, Mus musculus
tttatgctttgaatcatagtaactt

SEQ ID NO: 965690 - DNA, 25 bp, Mus musculus
tttatgctttgattcatagtaactt

SEQ ID NO: 965691 - DNA, 25 bp, Mus musculus
tttatggacaacactaacactgtgt

SEQ ID NO: 965692 - DNA, 25 bp, Mus musculus
tttatggacaactctaacactgtgt

SEQ ID NO: 965693 - DNA, 25 bp, Mus musculus
tttatggaccctcaatggaaactga

SEQ ID NO: 965694 - DNA, 25 bp, Mus musculus
tttatggaccctgaatggaaactga

SEQ ID NO: 965695 - DNA, 25 bp, Mus musculus
tttatggacctccacttcagactcg

SEQ ID NO: 965696 - DNA, 25 bp, Mus musculus
tttatggacctcgacttcagactcg

SEQ ID NO: 965697 - DNA, 25 bp, Mus musculus
tttatggatctaattgacccttggg

SEQ ID NO: 965698 - DNA, 25 bp, Mus musculus
tttatggatctatttgacccttggg

SEQ ID NO: 965699 - DNA, 25 bp, Mus musculus
tttatggatgcaacattgcgtggtc

SEQ ID NO: 965700 - DNA, 25 bp, Mus musculus
tttatggatgcatcattgcgtggtc

SEQ ID NO: 965701 - DNA, 25 bp, Mus musculus
tttatggatggaacctcagccagac

SEQ ID NO: 965702 - DNA, 25 bp, Mus musculus
tttatggatggatcctcagccagac

SEQ ID NO: 965703 - DNA, 25 bp, Mus musculus
tttatggattccaagcctatctctc

SEQ ID NO: 965704 - DNA, 25 bp, Mus musculus
tttatggattcctagcctatctctc

SEQ ID NO: 965705 - DNA, 25 bp, Mus musculus
tttatggcacaacttcactgcaccc

SEQ ID NO: 965706 - DNA, 25 bp, Mus musculus
tttatggcacaagttcactgcaccc

SEQ ID NO: 965707 - DNA, 25 bp, Mus musculus
tttatggcaccgaagtttgcttccc

SEQ ID NO: 965708 - DNA, 25 bp, Mus musculus
tttatggcaccgtagtttgcttccc

SEQ ID NO: 965709 - DNA, 25 bp, Mus musculus
tttatggcacctaatggcagccaga

SEQ ID NO: 965710 - DNA, 25 bp, Mus musculus
tttatggcaccttatggcagccaga

SEQ ID NO: 965711 - DNA, 25 bp, Mus musculus
tttatggcagtgctgtgaagcccac

SEQ ID NO: 965712 - DNA, 25 bp, Mus musculus
tttatggcagtggtgtgaagcccac

SEQ ID NO: 965713 - DNA, 25 bp, Mus musculus
tttatggcttatctccacttatcag

SEQ ID NO: 965714 - DNA, 25 bp, Mus musculus
tttatggcttatgtccacttatcag

SEQ ID NO: 965715 - DNA, 25 bp, Mus musculus
tttatggcttttctcccatgggcaa

SEQ ID NO: 965716 - DNA, 25 bp, Mus musculus
tttatggcttttgtcccatgggcaa

SEQ ID NO: 965717 - DNA, 25 bp, Mus musculus
tttatgggacctccgcaggaccttt

SEQ ID NO: 965718 - DNA, 25 bp, Mus musculus
tttatgggacctgcgcaggaccttt

SEQ ID NO: 965719 - DNA, 25 bp, Mus musculus
tttatgggagcacccactctctgac

SEQ ID NO: 965720 - DNA, 25 bp, Mus musculus
tttatgggagcagccactctctgac

SEQ ID NO: 965721 - DNA, 25 bp, Mus musculus
tttatgggcgtgagtcattcttctt

SEQ ID NO: 965722 - DNA, 25 bp, Mus musculus
tttatgggcgtgtgtcattcttctt

SEQ ID NO: 965723 - DNA, 25 bp, Mus musculus
tttatgggcttacggatgaacctca

SEQ ID NO: 965724 - DNA, 25 bp, Mus musculus
tttatgggcttagggatgaacctca

SEQ ID NO: 965725 - DNA, 25 bp, Mus musculus
tttatgggtatccattgctctctgc

SEQ ID NO: 965726 - DNA, 25 bp, Mus musculus
tttatgggtatcgattgctctctgc

SEQ ID NO: 965727 - DNA, 25 bp, Mus musculus
tttatgggttcaagtggactgctcc

SEQ ID NO: 965728 - DNA, 25 bp, Mus musculus
tttatgggttcatgtggactgctcc

SEQ ID NO: 965729 - DNA, 25 bp, Mus musculus
tttatgggtttacagtagggccagt

SEQ ID NO: 965730 - DNA, 25 bp, Mus musculus
tttatgggtttagagtagggccagt

SEQ ID NO: 965731 - DNA, 25 bp, Mus musculus
tttatggtcaccagcctgcttatct

SEQ ID NO: 965732 - DNA, 25 bp, Mus musculus
tttatggtcacctgcctgcttatct

SEQ ID NO: 965733 - DNA, 25 bp, Mus musculus
tttatggtcgggatgctcggatcaa

SEQ ID NO: 965734 - DNA, 25 bp, Mus musculus
tttatggtcgggttgctcggatcaa

SEQ ID NO: 965735 - DNA, 25 bp, Mus musculus
tttatggtcttgcttgtgcctctga

SEQ ID NO: 965736 - DNA, 25 bp, Mus musculus
tttatggtcttggttgtgcctctga

SEQ ID NO: 965737 - DNA, 25 bp, Mus musculus
tttatggtgactctcctatggagac

SEQ ID NO: 965738 - DNA, 25 bp, Mus musculus
tttatggtgactgtcctatggagac

SEQ ID NO: 965739 - DNA, 25 bp, Mus musculus
tttatggttatcactggaaatctgt

SEQ ID NO: 965740 - DNA, 25 bp, Mus musculus
tttatggttatctctggaaatctgt

SEQ ID NO: 965741 - DNA, 25 bp, Mus musculus
tttatggttgttagccacttaaaag

SEQ ID NO: 965742 - DNA, 25 bp, Mus musculus
tttatggttgtttgccacttaaaag

SEQ ID NO: 965743 - DNA, 25 bp, Mus musculus
tttatgtaaaatccacctccaatac

SEQ ID NO: 965744 - DNA, 25 bp, Mus musculus
tttatgtaaaatgcacctccaatac

SEQ ID NO: 965745 - DNA, 25 bp, Mus musculus
tttatgtatggtctgctatgtgggc

SEQ ID NO: 965746 - DNA, 25 bp, Mus musculus
tttatgtatggtgtgctatgtgggc

SEQ ID NO: 965747 - DNA, 25 bp, Mus musculus
tttatgtcacctatctatatcttag

SEQ ID NO: 965748 - DNA, 25 bp, Mus musculus
tttatgtcacctttctatatcttag

SEQ ID NO: 965749 - DNA, 25 bp, Mus musculus
tttatgtcagctaataaggtgcatc

SEQ ID NO: 965750 - DNA, 25 bp, Mus musculus
tttatgtcagcttataaggtgcatc

SEQ ID NO: 965751 - DNA, 25 bp, Mus musculus
tttatgtccaagattgtcctttctg

SEQ ID NO: 965752 - DNA, 25 bp, Mus musculus
tttatgtccaagtttgtcctttctg

SEQ ID NO: 965753 - DNA, 25 bp, Mus musculus
tttatgtccacgcttctatgaatgt

SEQ ID NO: 965754 - DNA, 25 bp, Mus musculus
tttatgtccacggttctatgaatgt

SEQ ID NO: 965755 - DNA, 25 bp, Mus musculus
tttatgtccccaagaaaacctgtca

SEQ ID NO: 965756 - DNA, 25 bp, Mus musculus
tttatgtccccatgaaaacctgtca

SEQ ID NO: 965757 - DNA, 25 bp, Mus musculus
tttatgtccctcaagagcttcctca

SEQ ID NO: 965758 - DNA, 25 bp, Mus musculus
tttatgtccctctagagcttcctca

SEQ ID NO: 965759 - DNA, 25 bp, Mus musculus
tttatgtcctgcctgatttcccatg

SEQ ID NO: 965760 - DNA, 25 bp, Mus musculus
tttatgtcctgcgtgatttcccatg

SEQ ID NO: 965761 - DNA, 25 bp, Mus musculus
tttatgtcggcgaggcaaaggtcct

SEQ ID NO: 965762 - DNA, 25 bp, Mus musculus
tttatgtcggcgtggcaaaggtcct

SEQ ID NO: 965763 - DNA, 25 bp, Mus musculus
tttatgtctattatacccttttcta

SEQ ID NO: 965764 - DNA, 25 bp, Mus musculus
tttatgtctattttacccttttcta

SEQ ID NO: 965765 - DNA, 25 bp, Mus musculus
tttatgtctggtatttccacacact

SEQ ID NO: 965766 - DNA, 25 bp, Mus musculus
tttatgtctggtttttccacacact

SEQ ID NO: 965767 - DNA, 25 bp, Mus musculus
tttatgtgaccaacccctccacaga

SEQ ID NO: 965768 - DNA, 25 bp, Mus musculus
tttatgtgaccatcccctccacaga

SEQ ID NO: 965769 - DNA, 25 bp, Mus musculus
tttatgtgacccagttcctcctgga

SEQ ID NO: 965770 - DNA, 25 bp, Mus musculus
tttatgtgaccctgttcctcctgga

SEQ ID NO: 965771 - DNA, 25 bp, Mus musculus
tttatgtgacgaatcctgggagtcc

SEQ ID NO: 965772 - DNA, 25 bp, Mus musculus
tttatgtgacgattcctgggagtcc

SEQ ID NO: 965773 - DNA, 25 bp, Mus musculus
tttatgtgatttctgcaagcttgct

SEQ ID NO: 965774 - DNA, 25 bp, Mus musculus
tttatgtgatttgtgcaagcttgct

SEQ ID NO: 965775 - DNA, 25 bp, Mus musculus
tttatgtgcaccaacttcatgccag

SEQ ID NO: 965776 - DNA, 25 bp, Mus musculus
tttatgtgcacctacttcatgccag

SEQ ID NO: 965777 - DNA, 25 bp, Mus musculus
tttatgtgcagcaggattaccttct

SEQ ID NO: 965778 - DNA, 25 bp, Mus musculus
tttatgtgcagctggattaccttct

SEQ ID NO: 965779 - DNA, 25 bp, Mus musculus
tttatgtgcatgagaatggcctaga

SEQ ID NO: 965780 - DNA, 25 bp, Mus musculus
tttatgtgcatgtgaatggcctaga

SEQ ID NO: 965781 - DNA, 25 bp, Mus musculus
tttatgtggattcagcattgctgca

SEQ ID NO: 965782 - DNA, 25 bp, Mus musculus
tttatgtggattgagcattgctgca

SEQ ID NO: 965783 - DNA, 25 bp, Mus musculus
tttatgtggcacaggtcttctcaaa

SEQ ID NO: 965784 - DNA, 25 bp, Mus musculus
tttatgtggcactggtcttctcaaa

SEQ ID NO: 965785 - DNA, 25 bp, Mus musculus
tttatgtggtccatctacctcttgc

SEQ ID NO: 965786 - DNA, 25 bp, Mus musculus
tttatgtggtccttctacctcttgc

SEQ ID NO: 965787 - DNA, 25 bp, Mus musculus
tttatgtgtcacagctggcttcacc

SEQ ID NO: 965788 - DNA, 25 bp, Mus musculus
tttatgtgtcactgctggcttcacc

SEQ ID NO: 965789 - DNA, 25 bp, Mus musculus
tttatgtgtgtgactttcctgcaca

SEQ ID NO: 965790 - DNA, 25 bp, Mus musculus
tttatgtgtgtgtctttcctgcaca

SEQ ID NO: 965791 - DNA, 25 bp, Mus musculus
tttatgtgttctcttcttttgcagc

SEQ ID NO: 965792 - DNA, 25 bp, Mus musculus
tttatgtgttctgttcttttgcagc

SEQ ID NO: 965793 - DNA, 25 bp, Mus musculus
tttatgtgttgtactcaggccttcc

SEQ ID NO: 965794 - DNA, 25 bp, Mus musculus
tttatgtgttgttctcaggccttcc

SEQ ID NO: 965795 - DNA, 25 bp, Mus musculus
tttatgtgttttcccaccccatcag

SEQ ID NO: 965796 - DNA, 25 bp, Mus musculus
tttatgtgttttgccaccccatcag

SEQ ID NO: 965797 - DNA, 25 bp, Mus musculus
tttatgttattccacgtttctcctg

SEQ ID NO: 965798 - DNA, 25 bp, Mus musculus
tttatgttattcgacgtttctcctg

SEQ ID NO: 965799 - DNA, 25 bp, Mus musculus
tttatgttccttagactctttgaag

SEQ ID NO: 965800 - DNA, 25 bp, Mus musculus
tttatgttcctttgactctttgaag

SEQ ID NO: 965801 - DNA, 25 bp, Mus musculus
tttatgttctagactgttgctcaaa

SEQ ID NO: 965802 - DNA, 25 bp, Mus musculus
tttatgttctagtctgttgctcaaa

SEQ ID NO: 965803 - DNA, 25 bp, Mus musculus
tttatgttcttgcagcttacgcccc

SEQ ID NO: 965804 - DNA, 25 bp, Mus musculus
tttatgttcttggagcttacgcccc

SEQ ID NO: 965805 - DNA, 25 bp, Mus musculus
tttatgttgagcaagttccccatgg

SEQ ID NO: 965806 - DNA, 25 bp, Mus musculus
tttatgttgagctagttccccatgg

SEQ ID NO: 965807 - DNA, 25 bp, Mus musculus
tttatgttgtcacccacaatgccta

SEQ ID NO: 965808 - DNA, 25 bp, Mus musculus
tttatgttgtcagccacaatgccta

SEQ ID NO: 965809 - DNA, 25 bp, Mus musculus
tttatgtttctcatgtcgatgagaa

SEQ ID NO: 965810 - DNA, 25 bp, Mus musculus
tttatgtttctcttgtcgatgagaa

SEQ ID NO: 965811 - DNA, 25 bp, Mus musculus
tttattaagttgcatttcttttggg

SEQ ID NO: 965812 - DNA, 25 bp, Mus musculus
tttattaagttggatttcttttggg

SEQ ID NO: 965813 - DNA, 25 bp, Mus musculus
tttattaattgtccaggatggtcct

SEQ ID NO: 965814 - DNA, 25 bp, Mus musculus
tttattaattgtgcaggatggtcct

SEQ ID NO: 965815 - DNA, 25 bp, Mus musculus
tttattacacacagtccttacctct

SEQ ID NO: 965816 - DNA, 25 bp, Mus musculus
tttattacacactgtccttacctct

SEQ ID NO: 965817 - DNA, 25 bp, Mus musculus
tttattacactactcagggcacaga

SEQ ID NO: 965818 - DNA, 25 bp, Mus musculus
tttattacactagtcagggcacaga

SEQ ID NO: 965819 - DNA, 25 bp, Mus musculus
tttattacagtcaacctgagggttt

SEQ ID NO: 965820 - DNA, 25 bp, Mus musculus
tttattacagtctacctgagggttt

SEQ ID NO: 965821 - DNA, 25 bp, Mus musculus
tttattaccactactttcaggcctg

SEQ ID NO: 965822 - DNA, 25 bp, Mus musculus
tttattaccacttctttcaggcctg

SEQ ID NO: 965823 - DNA, 25 bp, Mus musculus
tttattaccatcacttgggaggtgg

SEQ ID NO: 965824 - DNA, 25 bp, Mus musculus
tttattaccatctcttgggaggtgg

SEQ ID NO: 965825 - DNA, 25 bp, Mus musculus
tttattacctccctctaagcagctg

SEQ ID NO: 965826 - DNA, 25 bp, Mus musculus
tttattacctccgtctaagcagctg

SEQ ID NO: 965827 - DNA, 25 bp, Mus musculus
tttattacctttccatgcatttccc

SEQ ID NO: 965828 - DNA, 25 bp, Mus musculus
tttattacctttgcatgcatttccc

SEQ ID NO: 965829 - DNA, 25 bp, Mus musculus
tttattacgcgtactgcttggtgtt

SEQ ID NO: 965830 - DNA, 25 bp, Mus musculus
tttattacgcgttctgcttggtgtt

SEQ ID NO: 965831 - DNA, 25 bp, Mus musculus
tttattactagacctcaaccacagc

SEQ ID NO: 965832 - DNA, 25 bp, Mus musculus
tttattactagagctcaaccacagc

SEQ ID NO: 965833 - DNA, 25 bp, Mus musculus
tttattactgaccaaaggccaccaa

SEQ ID NO: 965834 - DNA, 25 bp, Mus musculus
tttattactgacgaaaggccaccaa

SEQ ID NO: 965835 - DNA, 25 bp, Mus musculus
tttattacttttctctaccctcctg

SEQ ID NO: 965836 - DNA, 25 bp, Mus musculus
tttattacttttgtctaccctcctg

SEQ ID NO: 965837 - DNA, 25 bp, Mus musculus
tttattagacctaagcttcccttct

SEQ ID NO: 965838 - DNA, 25 bp, Mus musculus
tttattagaccttagcttcccttct

SEQ ID NO: 965839 - DNA, 25 bp, Mus musculus
tttattagagttctttacaggctgt

SEQ ID NO: 965840 - DNA, 25 bp, Mus musculus
tttattagagttgtttacaggctgt

SEQ ID NO: 965841 - DNA, 25 bp, Mus musculus
tttattagccttctgttaagtgagc

SEQ ID NO: 965842 - DNA, 25 bp, Mus musculus
tttattagccttgtgttaagtgagc

SEQ ID NO: 965843 - DNA, 25 bp, Mus musculus
tttattagcgttaccacatcaccac

SEQ ID NO: 965844 - DNA, 25 bp, Mus musculus
tttattagcgtttccacatcaccac

SEQ ID NO: 965845 - DNA, 25 bp, Mus musculus
tttattagtcccactacccactcaa

SEQ ID NO: 965846 - DNA, 25 bp, Mus musculus
tttattagtccctctacccactcaa

SEQ ID NO: 965847 - DNA, 25 bp, Mus musculus
tttattatactccctcgacttctcc

SEQ ID NO: 965848 - DNA, 25 bp, Mus musculus
tttattatactcgctcgacttctcc

SEQ ID NO: 965849 - DNA, 25 bp, Mus musculus
tttattattggcagcttgcactcct

SEQ ID NO: 965850 - DNA, 25 bp, Mus musculus
tttattattggctgcttgcactcct

SEQ ID NO: 965851 - DNA, 25 bp, Mus musculus
tttattcacattacagggagagagg

SEQ ID NO: 965852 - DNA, 25 bp, Mus musculus
tttattcacatttcagggagagagg

SEQ ID NO: 965853 - DNA, 25 bp, Mus musculus
tttattcacccaaatcaaactaatt

SEQ ID NO: 965854 - DNA, 25 bp, Mus musculus
tttattcacccatatcaaactaatt

SEQ ID NO: 965855 - DNA, 25 bp, Mus musculus
tttattcagcctctattctcctgac

SEQ ID NO: 965856 - DNA, 25 bp, Mus musculus
tttattcagcctgtattctcctgac

SEQ ID NO: 965857 - DNA, 25 bp, Mus musculus
tttattcatatcatttcgctgttgt

SEQ ID NO: 965858 - DNA, 25 bp, Mus musculus
tttattcatatcttttcgctgttgt

SEQ ID NO: 965859 - DNA, 25 bp, Mus musculus
tttattcatggaaatgcagctttac

SEQ ID NO: 965860 - DNA, 25 bp, Mus musculus
tttattcatggatatgcagctttac

SEQ ID NO: 965861 - DNA, 25 bp, Mus musculus
tttattccagttactactacctcag

SEQ ID NO: 965862 - DNA, 25 bp, Mus musculus
tttattccagttcagctgcagctca

SEQ ID NO: 965863 - DNA, 25 bp, Mus musculus
tttattccagttgagctgcagctca

SEQ ID NO: 965864 - DNA, 25 bp, Mus musculus
tttattccagtttctactacctcag

SEQ ID NO: 965865 - DNA, 25 bp, Mus musculus
tttattccatccataaccatagaca

SEQ ID NO: 965866 - DNA, 25 bp, Mus musculus
tttattccatccttaaccatagaca

SEQ ID NO: 965867 - DNA, 25 bp, Mus musculus
tttattcccagaattcctttcctca

SEQ ID NO: 965868 - DNA, 25 bp, Mus musculus
tttattcccagatttcctttcctca

SEQ ID NO: 965869 - DNA, 25 bp, Mus musculus
tttattccccaacagtctcaggcat

SEQ ID NO: 965870 - DNA, 25 bp, Mus musculus
tttattccccaagagtctcaggcat

SEQ ID NO: 965871 - DNA, 25 bp, Mus musculus
tttattccccttaaggttgcagagg

SEQ ID NO: 965872 - DNA, 25 bp, Mus musculus
tttattcccctttaggttgcagagg

SEQ ID NO: 965873 - DNA, 25 bp, Mus musculus
tttattcccggcaagaatgctgttt

SEQ ID NO: 965874 - DNA, 25 bp, Mus musculus
tttattcccggctagaatgctgttt

SEQ ID NO: 965875 - DNA, 25 bp, Mus musculus
tttattcccttcatagcatttttgg

SEQ ID NO: 965876 - DNA, 25 bp, Mus musculus
tttattcccttcttagcatttttgg

SEQ ID NO: 965877 - DNA, 25 bp, Mus musculus
tttattccggttcccataccacatt

SEQ ID NO: 965878 - DNA, 25 bp, Mus musculus
tttattccggttgccataccacatt

SEQ ID NO: 965879 - DNA, 25 bp, Mus musculus
tttattcctataatgcattcttgca

SEQ ID NO: 965880 - DNA, 25 bp, Mus musculus
tttattcctatattgcattcttgca

SEQ ID NO: 965881 - DNA, 25 bp, Mus musculus
tttattcctccaccatcaaagtatg

SEQ ID NO: 965882 - DNA, 25 bp, Mus musculus
tttattcctccagcatcaaagtatg

SEQ ID NO: 965883 - DNA, 25 bp, Mus musculus
tttattcctctcaagtccagcatgg

SEQ ID NO: 965884 - DNA, 25 bp, Mus musculus
tttattcctctctagtccagcatgg

SEQ ID NO: 965885 - DNA, 25 bp, Mus musculus
tttattccttcaccgctcttgggtt

SEQ ID NO: 965886 - DNA, 25 bp, Mus musculus
tttattccttcagcgctcttgggtt

SEQ ID NO: 965887 - DNA, 25 bp, Mus musculus
tttattcctttaacggctgagcatt

SEQ ID NO: 965888 - DNA, 25 bp, Mus musculus
tttattcctttatcggctgagcatt

SEQ ID NO: 965889 - DNA, 25 bp, Mus musculus
tttattcgcagactcctggatttct

SEQ ID NO: 965890 - DNA, 25 bp, Mus musculus
tttattcgcagagtcctggatttct

SEQ ID NO: 965891 - DNA, 25 bp, Mus musculus
tttattcggcttacagctctcaggt

SEQ ID NO: 965892 - DNA, 25 bp, Mus musculus
tttattcggctttcagctctcaggt

SEQ ID NO: 965893 - DNA, 25 bp, Mus musculus
tttattcgtagaaatcagtagccag

SEQ ID NO: 965894 - DNA, 25 bp, Mus musculus
tttattcgtagatatcagtagccag

SEQ ID NO: 965895 - DNA, 25 bp, Mus musculus
tttattctaagacctgggctatact

SEQ ID NO: 965896 - DNA, 25 bp, Mus musculus
tttattctaagagctgggctatact

SEQ ID NO: 965897 - DNA, 25 bp, Mus musculus
tttattctaggcaagcatggtacca

SEQ ID NO: 965898 - DNA, 25 bp, Mus musculus
tttattctaggctagcatggtacca

SEQ ID NO: 965899 - DNA, 25 bp, Mus musculus
tttattctctccagacctggacaaa

SEQ ID NO: 965900 - DNA, 25 bp, Mus musculus
tttattctctcctgacctggacaaa

SEQ ID NO: 965901 - DNA, 25 bp, Mus musculus
tttattctctctatacaccgccata

SEQ ID NO: 965902 - DNA, 25 bp, Mus musculus
tttattctctctttacaccgccata

SEQ ID NO: 965903 - DNA, 25 bp, Mus musculus
tttattctgaccagaacattccgtt

SEQ ID NO: 965904 - DNA, 25 bp, Mus musculus
tttattctgacctgaacattccgtt

SEQ ID NO: 965905 - DNA, 25 bp, Mus musculus
tttattctgcttaaccttactactc

SEQ ID NO: 965906 - DNA, 25 bp, Mus musculus
tttattctgctttaccttactactc

SEQ ID NO: 965907 - DNA, 25 bp, Mus musculus
tttattctggaactgagtgcggttc

SEQ ID NO: 965908 - DNA, 25 bp, Mus musculus
tttattctggaagtgagtgcggttc

SEQ ID NO: 965909 - DNA, 25 bp, Mus musculus
tttattctgtccctggcatgttcaa

SEQ ID NO: 965910 - DNA, 25 bp, Mus musculus
tttattctgtccgtggcatgttcaa

SEQ ID NO: 965911 - DNA, 25 bp, Mus musculus
tttattcttactattccctgtgcag

SEQ ID NO: 965912 - DNA, 25 bp, Mus musculus
tttattcttacttttccctgtgcag

SEQ ID NO: 965913 - DNA, 25 bp, Mus musculus
tttattcttcccagtctttgatgac

SEQ ID NO: 965914 - DNA, 25 bp, Mus musculus
tttattcttccctgtctttgatgac

SEQ ID NO: 965915 - DNA, 25 bp, Mus musculus
tttattcttggcatacatttctgac

SEQ ID NO: 965916 - DNA, 25 bp, Mus musculus
tttattcttggcttacatttctgac

SEQ ID NO: 965917 - DNA, 25 bp, Mus musculus
tttattcttgtgacttcatttccaa

SEQ ID NO: 965918 - DNA, 25 bp, Mus musculus
tttattcttgtgtcttcatttccaa

SEQ ID NO: 965919 - DNA, 25 bp, Mus musculus
tttattctttaaacagttcgccccg

SEQ ID NO: 965920 - DNA, 25 bp, Mus musculus
tttattctttaatcagttcgccccg

SEQ ID NO: 965921 - DNA, 25 bp, Mus musculus
tttattgaacccacccactcagatg

SEQ ID NO: 965922 - DNA, 25 bp, Mus musculus
tttattgaacccatactgtgggcaa

SEQ ID NO: 965923 - DNA, 25 bp, Mus musculus
tttattgaaccctcccactcagatg

SEQ ID NO: 965924 - DNA, 25 bp, Mus musculus
tttattgaacccttactgtgggcaa

SEQ ID NO: 965925 - DNA, 25 bp, Mus musculus
tttattgaccatctactgtgtgcat

SEQ ID NO: 965926 - DNA, 25 bp, Mus musculus
tttattgaccatgtactgtgtgcat

SEQ ID NO: 965927 - DNA, 25 bp, Mus musculus
tttattgactccagtgcccaggaca

SEQ ID NO: 965928 - DNA, 25 bp, Mus musculus
tttattgactcctgtgcccaggaca

SEQ ID NO: 965929 - DNA, 25 bp, Mus musculus
tttattgagaccagcaatatcaggg

SEQ ID NO: 965930 - DNA, 25 bp, Mus musculus
tttattgagacctgcaatatcaggg

SEQ ID NO: 965931 - DNA, 25 bp, Mus musculus
tttattgaggatctgccccgagcgc

SEQ ID NO: 965932 - DNA, 25 bp, Mus musculus
tttattgaggatgtgccccgagcgc

SEQ ID NO: 965933 - DNA, 25 bp, Mus musculus
tttattgagtaccttcagtgcccag

SEQ ID NO: 965934 - DNA, 25 bp, Mus musculus
tttattgagtacgttcagtgcccag

SEQ ID NO: 965935 - DNA, 25 bp, Mus musculus
tttattgattatacaccctctaggt

SEQ ID NO: 965936 - DNA, 25 bp, Mus musculus
tttattgattattcaccctctaggt

SEQ ID NO: 965937 - DNA, 25 bp, Mus musculus
tttattgcaagaacttccccatctc

SEQ ID NO: 965938 - DNA, 25 bp, Mus musculus
tttattgcaagatcttccccatctc

SEQ ID NO: 965939 - DNA, 25 bp, Mus musculus
tttattgcagccagagggatctctt

SEQ ID NO: 965940 - DNA, 25 bp, Mus musculus
tttattgcagcctgagggatctctt

SEQ ID NO: 965941 - DNA, 25 bp, Mus musculus
tttattgccagtcttttcacctgta

SEQ ID NO: 965942 - DNA, 25 bp, Mus musculus
tttattgccagtgttttcacctgta

SEQ ID NO: 965943 - DNA, 25 bp, Mus musculus
tttattgcccagagaccatttccat

SEQ ID NO: 965944 - DNA, 25 bp, Mus musculus
tttattgcccagtgaccatttccat

SEQ ID NO: 965945 - DNA, 25 bp, Mus musculus
tttattgctcctaaaggtgacctgg

SEQ ID NO: 965946 - DNA, 25 bp, Mus musculus
tttattgctccttaaggtgacctgg

SEQ ID NO: 965947 - DNA, 25 bp, Mus musculus
tttattgctgacatagcctctctta

SEQ ID NO: 965948 - DNA, 25 bp, Mus musculus
tttattgctgacttagcctctctta

SEQ ID NO: 965949 - DNA, 25 bp, Mus musculus
tttattgctgcgattgtgggtgctg

SEQ ID NO: 965950 - DNA, 25 bp, Mus musculus
tttattgctgcgtttgtgggtgctg

SEQ ID NO: 965951 - DNA, 25 bp, Mus musculus
tttattgctttgaaacccactggtt

SEQ ID NO: 965952 - DNA, 25 bp, Mus musculus
tttattgctttgtaacccactggtt

SEQ ID NO: 965953 - DNA, 25 bp, Mus musculus
tttattggcggcactgtgaccccta

SEQ ID NO: 965954 - DNA, 25 bp, Mus musculus
tttattggcggctctgtgaccccta

SEQ ID NO: 965955 - DNA, 25 bp, Mus musculus
tttattggcggtaatcctgacggct

SEQ ID NO: 965956 - DNA, 25 bp, Mus musculus
tttattggcggttatcctgacggct

SEQ ID NO: 965957 - DNA, 25 bp, Mus musculus
tttattggtcagcaatcctggtcca

SEQ ID NO: 965958 - DNA, 25 bp, Mus musculus
tttattggtcaggaatcctggtcca

SEQ ID NO: 965959 - DNA, 25 bp, Mus musculus
tttattgtaaagaccagtgaccatg

SEQ ID NO: 965960 - DNA, 25 bp, Mus musculus
tttattgtaaagtccagtgaccatg

SEQ ID NO: 965961 - DNA, 25 bp, Mus musculus
tttattgtacaaaccatgtgagcct

SEQ ID NO: 965962 - DNA, 25 bp, Mus musculus
tttattgtacaatccatgtgagcct

SEQ ID NO: 965963 - DNA, 25 bp, Mus musculus
tttattgtcactagtcgggatttag

SEQ ID NO: 965964 - DNA, 25 bp, Mus musculus
tttattgtcacttgtcgggatttag

SEQ ID NO: 965965 - DNA, 25 bp, Mus musculus
tttattgtcattcagacgccttgtc

SEQ ID NO: 965966 - DNA, 25 bp, Mus musculus
tttattgtcattgagacgccttgtc

SEQ ID NO: 965967 - DNA, 25 bp, Mus musculus
tttattgtctgtactttctatggaa

SEQ ID NO: 965968 - DNA, 25 bp, Mus musculus
tttattgtctgttctttctatggaa

SEQ ID NO: 965969 - DNA, 25 bp, Mus musculus
tttattgtgccacacctggagcaga

SEQ ID NO: 965970 - DNA, 25 bp, Mus musculus
tttattgtgccagacctggagcaga

SEQ ID NO: 965971 - DNA, 25 bp, Mus musculus
tttattgtgcccaagctgggtgtca

SEQ ID NO: 965972 - DNA, 25 bp, Mus musculus
tttattgtgccctagctgggtgtca

SEQ ID NO: 965973 - DNA, 25 bp, Mus musculus
tttattgtgccgatgcttggccagg

SEQ ID NO: 965974 - DNA, 25 bp, Mus musculus
tttattgtgccgttgcttggccagg

SEQ ID NO: 965975 - DNA, 25 bp, Mus musculus
tttattgtgcctaaagtccttgctt

SEQ ID NO: 965976 - DNA, 25 bp, Mus musculus
tttattgtgccttaagtccttgctt

SEQ ID NO: 965977 - DNA, 25 bp, Mus musculus
tttattgtggccaggcacgatttcc

SEQ ID NO: 965978 - DNA, 25 bp, Mus musculus
tttattgtggcctggcacgatttcc

SEQ ID NO: 965979 - DNA, 25 bp, Mus musculus
tttattgttgcactgttctcttggg

SEQ ID NO: 965980 - DNA, 25 bp, Mus musculus
tttattgttgcagtgttctcttggg

SEQ ID NO: 965981 - DNA, 25 bp, Mus musculus
tttattgttgttcttttgacttaca

SEQ ID NO: 965982 - DNA, 25 bp, Mus musculus
tttattgttgttgttttgacttaca

SEQ ID NO: 965983 - DNA, 25 bp, Mus musculus
tttattgtttacctctgctgtgcca

SEQ ID NO: 965984 - DNA, 25 bp, Mus musculus
tttattgtttacgtctgctgtgcca

SEQ ID NO: 965985 - DNA, 25 bp, Mus musculus
tttattgtttagattgtgcccagaa

SEQ ID NO: 965986 - DNA, 25 bp, Mus musculus
tttattgtttagtttgtgcccagaa

SEQ ID NO: 965987 - DNA, 25 bp, Mus musculus
tttattgtttttcccctcctggcat

SEQ ID NO: 965988 - DNA, 25 bp, Mus musculus
tttattgtttttgccctcctggcat

SEQ ID NO: 965989 - DNA, 25 bp, Mus musculus
tttatttacaccatggcatcccctg

SEQ ID NO: 965990 - DNA, 25 bp, Mus musculus
tttatttacaccttggcatcccctg

SEQ ID NO: 965991 - DNA, 25 bp, Mus musculus
tttatttacagtcctccttttgcac

SEQ ID NO: 965992 - DNA, 25 bp, Mus musculus
tttatttacagtgctccttttgcac

SEQ ID NO: 965993 - DNA, 25 bp, Mus musculus
tttatttaccgtccatctcccaaat

SEQ ID NO: 965994 - DNA, 25 bp, Mus musculus
tttatttaccgtgcatctcccaaat

SEQ ID NO: 965995 - DNA, 25 bp, Mus musculus
tttatttactctattctcagaacag

SEQ ID NO: 965996 - DNA, 25 bp, Mus musculus
tttatttactcttttctcagaacag

SEQ ID NO: 965997 - DNA, 25 bp, Mus musculus
tttatttactgcctctgtctgctga

SEQ ID NO: 965998 - DNA, 25 bp, Mus musculus
tttatttactgcgtctgtctgctga

SEQ ID NO: 965999 - DNA, 25 bp, Mus musculus
tttatttagatgattctgtttgcta

SEQ ID NO: 966000 - DNA, 25 bp, Mus musculus
tttatttagatgtttctgtttgcta

SEQ ID NO: 966001 - DNA, 25 bp, Mus musculus
tttatttagcccacacaccaagcaa

SEQ ID NO: 966002 - DNA, 25 bp, Mus musculus
tttatttagccctcacaccaagcaa

SEQ ID NO: 966003 - DNA, 25 bp, Mus musculus
tttatttagcctctcagtgcctaat

SEQ ID NO: 966004 - DNA, 25 bp, Mus musculus
tttatttagcctgtcagtgcctaat

SEQ ID NO: 966005 - DNA, 25 bp, Mus musculus
tttatttatctgaactctccctgga

SEQ ID NO: 966006 - DNA, 25 bp, Mus musculus
tttatttatctgtactctccctgga

SEQ ID NO: 966007 - DNA, 25 bp, Mus musculus
tttatttatcttacaagactgtgcc

SEQ ID NO: 966008 - DNA, 25 bp, Mus musculus
tttatttatctttcaagactgtgcc

SEQ ID NO: 966009 - DNA, 25 bp, Mus musculus
tttatttatgttcccagcacagagc

SEQ ID NO: 966010 - DNA, 25 bp, Mus musculus
tttatttatgttgccagcacagagc

SEQ ID NO: 966011 - DNA, 25 bp, Mus musculus
tttatttcaacccaaggtcatttga

SEQ ID NO: 966012 - DNA, 25 bp, Mus musculus
tttatttcaaccctctctatatcga

SEQ ID NO: 966013 - DNA, 25 bp, Mus musculus
tttatttcaaccgaaggtcatttga

SEQ ID NO: 966014 - DNA, 25 bp, Mus musculus
tttatttcaaccgtctctatatcga

SEQ ID NO: 966015 - DNA, 25 bp, Mus musculus
tttatttcacaaacaggaccagctg

SEQ ID NO: 966016 - DNA, 25 bp, Mus musculus
tttatttcacaatcaggaccagctg

SEQ ID NO: 966017 - DNA, 25 bp, Mus musculus
tttatttcagttaccatccccatag

SEQ ID NO: 966018 - DNA, 25 bp, Mus musculus
tttatttcagttcagccaaggtcag

SEQ ID NO: 966019 - DNA, 25 bp, Mus musculus
tttatttcagttgagccaaggtcag

SEQ ID NO: 966020 - DNA, 25 bp, Mus musculus
tttatttcagtttccatccccatag

SEQ ID NO: 966021 - DNA, 25 bp, Mus musculus
tttatttcatcaactcacaacacat

SEQ ID NO: 966022 - DNA, 25 bp, Mus musculus
tttatttcatcatctcacaacacat

SEQ ID NO: 966023 - DNA, 25 bp, Mus musculus
tttatttcatccagtgtgcacatgc

SEQ ID NO: 966024 - DNA, 25 bp, Mus musculus
tttatttcatcctgtgtgcacatgc

SEQ ID NO: 966025 - DNA, 25 bp, Mus musculus
tttatttccaggctaatcctcagga

SEQ ID NO: 966026 - DNA, 25 bp, Mus musculus
tttatttccagggtaatcctcagga

SEQ ID NO: 966027 - DNA, 25 bp, Mus musculus
tttatttcccatcaaatatgagtta

SEQ ID NO: 966028 - DNA, 25 bp, Mus musculus
tttatttcccatgaaatatgagtta

SEQ ID NO: 966029 - DNA, 25 bp, Mus musculus
tttatttccccaacaagtctaccaa

SEQ ID NO: 966030 - DNA, 25 bp, Mus musculus
tttatttccccatcaagtctaccaa

SEQ ID NO: 966031 - DNA, 25 bp, Mus musculus
tttatttcccgtagaaccacccatg

SEQ ID NO: 966032 - DNA, 25 bp, Mus musculus
tttatttcccgttgaaccacccatg

SEQ ID NO: 966033 - DNA, 25 bp, Mus musculus
tttatttccgcaaatatttggaagc

SEQ ID NO: 966034 - DNA, 25 bp, Mus musculus
tttatttccgcatatatttggaagc

SEQ ID NO: 966035 - DNA, 25 bp, Mus musculus
tttatttccgttctctctatgctgt

SEQ ID NO: 966036 - DNA, 25 bp, Mus musculus
tttatttccgttgtctctatgctgt

SEQ ID NO: 966037 - DNA, 25 bp, Mus musculus
tttatttcctgcattatgggcccca

SEQ ID NO: 966038 - DNA, 25 bp, Mus musculus
tttatttcctgctttatgggcccca

SEQ ID NO: 966039 - DNA, 25 bp, Mus musculus
tttatttcctgtaagatcgtgaatg

SEQ ID NO: 966040 - DNA, 25 bp, Mus musculus
tttatttcctgttagatcgtgaatg

SEQ ID NO: 966041 - DNA, 25 bp, Mus musculus
tttatttccttgattccatccaacc

SEQ ID NO: 966042 - DNA, 25 bp, Mus musculus
tttatttccttgtttccatccaacc

SEQ ID NO: 966043 - DNA, 25 bp, Mus musculus
tttatttcctttcgccttcatacac

SEQ ID NO: 966044 - DNA, 25 bp, Mus musculus
tttatttcctttggccttcatacac

SEQ ID NO: 966045 - DNA, 25 bp, Mus musculus
tttatttctaaaagtgttaccaggt

SEQ ID NO: 966046 - DNA, 25 bp, Mus musculus
tttatttctaaatgtgttaccaggt

SEQ ID NO: 966047 - DNA, 25 bp, Mus musculus
tttatttctataatgactccccttc

SEQ ID NO: 966048 - DNA, 25 bp, Mus musculus
tttatttctatattgactccccttc

SEQ ID NO: 966049 - DNA, 25 bp, Mus musculus
tttatttctatcaccaaggcccaac

SEQ ID NO: 966050 - DNA, 25 bp, Mus musculus
tttatttctatctccaaggcccaac

SEQ ID NO: 966051 - DNA, 25 bp, Mus musculus
tttatttctgaaccatggtctcgtg

SEQ ID NO: 966052 - DNA, 25 bp, Mus musculus
tttatttctgaacccaccccacgag

SEQ ID NO: 966053 - DNA, 25 bp, Mus musculus
tttatttctgaagcatggtctcgtg

SEQ ID NO: 966054 - DNA, 25 bp, Mus musculus
tttatttctgaagccaccccacgag

SEQ ID NO: 966055 - DNA, 25 bp, Mus musculus
tttatttctgcacggctgaaagcac

SEQ ID NO: 966056 - DNA, 25 bp, Mus musculus
tttatttctgcagggctgaaagcac

SEQ ID NO: 966057 - DNA, 25 bp, Mus musculus
tttatttctgccagctaacatcctc

SEQ ID NO: 966058 - DNA, 25 bp, Mus musculus
tttatttctgcctgctaacatcctc

SEQ ID NO: 966059 - DNA, 25 bp, Mus musculus
tttatttctgtaaagccaagaccta

SEQ ID NO: 966060 - DNA, 25 bp, Mus musculus
tttatttctgtaacggagcacattt

SEQ ID NO: 966061 - DNA, 25 bp, Mus musculus
tttatttctgtatagccaagaccta

SEQ ID NO: 966062 - DNA, 25 bp, Mus musculus
tttatttctgtatcggagcacattt

SEQ ID NO: 966063 - DNA, 25 bp, Mus musculus
tttatttctgtgatattgggttttc

SEQ ID NO: 966064 - DNA, 25 bp, Mus musculus
tttatttctgtgttattgggttttc

SEQ ID NO: 966065 - DNA, 25 bp, Mus musculus
tttatttcttttagtgacgtcacac

SEQ ID NO: 966066 - DNA, 25 bp, Mus musculus
tttatttctttttgtgacgtcacac

SEQ ID NO: 966067 - DNA, 25 bp, Mus musculus
tttatttgacttaaacatctgtagc

SEQ ID NO: 966068 - DNA, 25 bp, Mus musculus
tttatttgactttaacatctgtagc

SEQ ID NO: 966069 - DNA, 25 bp, Mus musculus
tttatttgatttccctgcctaagtg

SEQ ID NO: 966070 - DNA, 25 bp, Mus musculus
tttatttgatttgcctgcctaagtg

SEQ ID NO: 966071 - DNA, 25 bp, Mus musculus
tttatttgcctaaacccaagccatc

SEQ ID NO: 966072 - DNA, 25 bp, Mus musculus
tttatttgcctatacccaagccatc

SEQ ID NO: 966073 - DNA, 25 bp, Mus musculus
tttatttgcctccaagtctactgac

SEQ ID NO: 966074 - DNA, 25 bp, Mus musculus
tttatttgcctcgaagtctactgac

SEQ ID NO: 966075 - DNA, 25 bp, Mus musculus
tttatttgctttctgccggaagtct

SEQ ID NO: 966076 - DNA, 25 bp, Mus musculus
tttatttgctttgtgccggaagtct

SEQ ID NO: 966077 - DNA, 25 bp, Mus musculus
tttatttgttctatccttacctggt

SEQ ID NO: 966078 - DNA, 25 bp, Mus musculus
tttatttgttctttccttacctggt

SEQ ID NO: 966079 - DNA, 25 bp, Mus musculus
tttattttacccaagaactgcaagt

SEQ ID NO: 966080 - DNA, 25 bp, Mus musculus
tttattttaccctagaactgcaagt

SEQ ID NO: 966081 - DNA, 25 bp, Mus musculus
tttattttagctcagatgtcaccaa

SEQ ID NO: 966082 - DNA, 25 bp, Mus musculus
tttattttagctgagatgtcaccaa

SEQ ID NO: 966083 - DNA, 25 bp, Mus musculus
tttattttccacagcgctctactgc

SEQ ID NO: 966084 - DNA, 25 bp, Mus musculus
tttattttccactgcgctctactgc

SEQ ID NO: 966085 - DNA, 25 bp, Mus musculus
tttattttccatactgtcacccaca

SEQ ID NO: 966086 - DNA, 25 bp, Mus musculus
tttattttccattctgtcacccaca

SEQ ID NO: 966087 - DNA, 25 bp, Mus musculus
tttattttcttgcagcttgcgcttt

SEQ ID NO: 966088 - DNA, 25 bp, Mus musculus
tttattttcttggagcttgcgcttt

SEQ ID NO: 966089 - DNA, 25 bp, Mus musculus
tttattttgaaaccccattctcagt

SEQ ID NO: 966090 - DNA, 25 bp, Mus musculus
tttattttgaaagcccattctcagt

SEQ ID NO: 966091 - DNA, 25 bp, Mus musculus
tttattttgacccaggtatggtttg

SEQ ID NO: 966092 - DNA, 25 bp, Mus musculus
tttattttgaccgaggtatggtttg

SEQ ID NO: 966093 - DNA, 25 bp, Mus musculus
tttattttgagtcctgtttcctttt

SEQ ID NO: 966094 - DNA, 25 bp, Mus musculus
tttattttgagtgctgtttcctttt

SEQ ID NO: 966095 - DNA, 25 bp, Mus musculus
tttattttgccaactttaagtcaca

SEQ ID NO: 966096 - DNA, 25 bp, Mus musculus
tttattttgccatctttaagtcaca

SEQ ID NO: 966097 - DNA, 25 bp, Mus musculus
tttattttgcctcaccagttcaggt

SEQ ID NO: 966098 - DNA, 25 bp, Mus musculus
tttattttgcctgaccagttcaggt

SEQ ID NO: 966099 - DNA, 25 bp, Mus musculus
tttattttgctaccctctggtccag

SEQ ID NO: 966100 - DNA, 25 bp, Mus musculus
tttattttgctagcctctggtccag

SEQ ID NO: 966101 - DNA, 25 bp, Mus musculus
tttattttgtccacccttcaagaca

SEQ ID NO: 966102 - DNA, 25 bp, Mus musculus
tttattttgtcctcccttcaagaca

SEQ ID NO: 966103 - DNA, 25 bp, Mus musculus
tttatttttctaactactgaccata

SEQ ID NO: 966104 - DNA, 25 bp, Mus musculus
tttatttttctactcactgttccct

SEQ ID NO: 966105 - DNA, 25 bp, Mus musculus
tttatttttctagtcactgttccct

SEQ ID NO: 966106 - DNA, 25 bp, Mus musculus
tttatttttctatctactgaccata

SEQ ID NO: 966107 - DNA, 25 bp, Mus musculus
tttatttttctcacagcttcacgtt

SEQ ID NO: 966108 - DNA, 25 bp, Mus musculus
tttatttttctccaagcctcagttt

SEQ ID NO: 966109 - DNA, 25 bp, Mus musculus
tttatttttctcgaagcctcagttt

SEQ ID NO: 966110 - DNA, 25 bp, Mus musculus
tttatttttctctcagcttcacgtt

SEQ ID NO: 966111 - DNA, 25 bp, Mus musculus
tttatttttctgagggaacgaggtg

SEQ ID NO: 966112 - DNA, 25 bp, Mus musculus
tttatttttctgtgggaacgaggtg

SEQ ID NO: 966113 - DNA, 25 bp, Mus musculus
tttatttttgccatgtgtgccttgg

SEQ ID NO: 966114 - DNA, 25 bp, Mus musculus
tttatttttgccttgtgtgccttgg

SEQ ID NO: 966115 - DNA, 25 bp, Mus musculus
tttatttttgttcatctgctgctgt

SEQ ID NO: 966116 - DNA, 25 bp, Mus musculus
tttatttttgttgatctgctgctgt

SEQ ID NO: 966117 - DNA, 25 bp, Mus musculus
tttattttttaccatgccacccaat

SEQ ID NO: 966118 - DNA, 25 bp, Mus musculus
tttattttttacgatgccacccaat

SEQ ID NO: 966119 - DNA, 25 bp, Mus musculus
tttattttttatcgcacacggtggg

SEQ ID NO: 966120 - DNA, 25 bp, Mus musculus
tttattttttatggcacacggtggg

SEQ ID NO: 966121 - DNA, 25 bp, Mus musculus
tttcaaaacaatccctcacgagact

SEQ ID NO: 966122 - DNA, 25 bp, Mus musculus
tttcaaaacaatgcctcacgagact

SEQ ID NO: 966123 - DNA, 25 bp, Mus musculus
tttcaaaaccggctctgcatacgac

SEQ ID NO: 966124 - DNA, 25 bp, Mus musculus
tttcaaaaccgggtctgcatacgac

SEQ ID NO: 966125 - DNA, 25 bp, Mus musculus
tttcaaaagcccagtcctagtttag

SEQ ID NO: 966126 - DNA, 25 bp, Mus musculus
tttcaaaagccctgtcctagtttag

SEQ ID NO: 966127 - DNA, 25 bp, Mus musculus
tttcaaaagcctacaccattcccag

SEQ ID NO: 966128 - DNA, 25 bp, Mus musculus
tttcaaaagccttcaccattcccag

SEQ ID NO: 966129 - DNA, 25 bp, Mus musculus
tttcaaaatagcattccccaagttt

SEQ ID NO: 966130 - DNA, 25 bp, Mus musculus
tttcaaaatagctttccccaagttt

SEQ ID NO: 966131 - DNA, 25 bp, Mus musculus
tttcaaaatcagatgtagctttcga

SEQ ID NO: 966132 - DNA, 25 bp, Mus musculus
tttcaaaatcagttgtagctttcga

SEQ ID NO: 966133 - DNA, 25 bp, Mus musculus
tttcaaaccccaatgctctttagaa

SEQ ID NO: 966134 - DNA, 25 bp, Mus musculus
tttcaaaccccattgctctttagaa

SEQ ID NO: 966135 - DNA, 25 bp, Mus musculus
tttcaaacctccactctgcttcaat

SEQ ID NO: 966136 - DNA, 25 bp, Mus musculus
tttcaaacctcctctctgcttcaat

SEQ ID NO: 966137 - DNA, 25 bp, Mus musculus
tttcaaacgtgtccattaggatttc

SEQ ID NO: 966138 - DNA, 25 bp, Mus musculus
tttcaaacgtgtgcattaggatttc

SEQ ID NO: 966139 - DNA, 25 bp, Mus musculus
tttcaaactcagagacaaggacttt

SEQ ID NO: 966140 - DNA, 25 bp, Mus musculus
tttcaaactcagtgacaaggacttt

SEQ ID NO: 966141 - DNA, 25 bp, Mus musculus
tttcaaacttctcccttacactgta

SEQ ID NO: 966142 - DNA, 25 bp, Mus musculus
tttcaaacttctgccttacactgta

SEQ ID NO: 966143 - DNA, 25 bp, Mus musculus
tttcaaagaaccatccgcctttggg

SEQ ID NO: 966144 - DNA, 25 bp, Mus musculus
tttcaaagaaccttccgcctttggg

SEQ ID NO: 966145 - DNA, 25 bp, Mus musculus
tttcaaagaatgaggcaacttgctt

SEQ ID NO: 966146 - DNA, 25 bp, Mus musculus
tttcaaagaatgtggcaacttgctt

SEQ ID NO: 966147 - DNA, 25 bp, Mus musculus
tttcaaagaggcaagatttcattgg

SEQ ID NO: 966148 - DNA, 25 bp, Mus musculus
tttcaaagaggctagatttcattgg

SEQ ID NO: 966149 - DNA, 25 bp, Mus musculus
tttcaaagcacccacaaatcttcct

SEQ ID NO: 966150 - DNA, 25 bp, Mus musculus
tttcaaagcaccgacaaatcttcct

SEQ ID NO: 966151 - DNA, 25 bp, Mus musculus
tttcaaagcccaatagtgtttggca

SEQ ID NO: 966152 - DNA, 25 bp, Mus musculus
tttcaaagcccattagtgtttggca

SEQ ID NO: 966153 - DNA, 25 bp, Mus musculus
tttcaaagcctccagccaagggttt

SEQ ID NO: 966154 - DNA, 25 bp, Mus musculus
tttcaaagcctcgagccaagggttt

SEQ ID NO: 966155 - DNA, 25 bp, Mus musculus
tttcaaagcttgctacgcagcaggt

SEQ ID NO: 966156 - DNA, 25 bp, Mus musculus
tttcaaagcttggtacgcagcaggt

SEQ ID NO: 966157 - DNA, 25 bp, Mus musculus
tttcaaaggagcacgaggtggtgtc

SEQ ID NO: 966158 - DNA, 25 bp, Mus musculus
tttcaaaggagctcgaggtggtgtc

SEQ ID NO: 966159 - DNA, 25 bp, Mus musculus
tttcaaaggcataaagtccgtgact

SEQ ID NO: 966160 - DNA, 25 bp, Mus musculus
tttcaaaggcattaagtccgtgact

SEQ ID NO: 966161 - DNA, 25 bp, Mus musculus
tttcaaataagcacggccacactgt

SEQ ID NO: 966162 - DNA, 25 bp, Mus musculus
tttcaaataagctcggccacactgt

SEQ ID NO: 966163 - DNA, 25 bp, Mus musculus
tttcaaatacccaaagctgccagtt

SEQ ID NO: 966164 - DNA, 25 bp, Mus musculus
tttcaaataccctaagctgccagtt

SEQ ID NO: 966165 - DNA, 25 bp, Mus musculus
tttcaaatcacacccatcagaccac

SEQ ID NO: 966166 - DNA, 25 bp, Mus musculus
tttcaaatcacagccatcagaccac

SEQ ID NO: 966167 - DNA, 25 bp, Mus musculus
tttcaaatcatacaacccaatccca

SEQ ID NO: 966168 - DNA, 25 bp, Mus musculus
tttcaaatcatagaacccaatccca

SEQ ID NO: 966169 - DNA, 25 bp, Mus musculus
tttcaaatccttcctgctcaaagac

SEQ ID NO: 966170 - DNA, 25 bp, Mus musculus
tttcaaatccttgctgctcaaagac

SEQ ID NO: 966171 - DNA, 25 bp, Mus musculus
tttcaaatgggtctgtttttccact

SEQ ID NO: 966172 - DNA, 25 bp, Mus musculus
tttcaaatgggtgtgtttttccact

SEQ ID NO: 966173 - DNA, 25 bp, Mus musculus
tttcaaatgtttcacttgcaggttt

SEQ ID NO: 966174 - DNA, 25 bp, Mus musculus
tttcaaatgtttgacttgcaggttt

SEQ ID NO: 966175 - DNA, 25 bp, Mus musculus
tttcaaatttttctgtgctccccat

SEQ ID NO: 966176 - DNA, 25 bp, Mus musculus
tttcaaatttttgtgtgctccccat

SEQ ID NO: 966177 - DNA, 25 bp, Mus musculus
tttcaacaaaaaaccagctccgact

SEQ ID NO: 966178 - DNA, 25 bp, Mus musculus
tttcaacaaaaatccagctccgact

SEQ ID NO: 966179 - DNA, 25 bp, Mus musculus
tttcaacaagtacagctccatcaga

SEQ ID NO: 966180 - DNA, 25 bp, Mus musculus
tttcaacaagtagagctccatcaga

SEQ ID NO: 966181 - DNA, 25 bp, Mus musculus
tttcaacagaagaggcactgcccaa

SEQ ID NO: 966182 - DNA, 25 bp, Mus musculus
tttcaacagaagtggcactgcccaa

SEQ ID NO: 966183 - DNA, 25 bp, Mus musculus
tttcaacagctgaggcaagccaagt

SEQ ID NO: 966184 - DNA, 25 bp, Mus musculus
tttcaacagctgtggcaagccaagt

SEQ ID NO: 966185 - DNA, 25 bp, Mus musculus
tttcaacaggacacaccggagcaag

SEQ ID NO: 966186 - DNA, 25 bp, Mus musculus
tttcaacaggactcaccggagcaag

SEQ ID NO: 966187 - DNA, 25 bp, Mus musculus
tttcaacagtgacgcgacatcgatt

SEQ ID NO: 966188 - DNA, 25 bp, Mus musculus
tttcaacagtgaggcgacatcgatt

SEQ ID NO: 966189 - DNA, 25 bp, Mus musculus
tttcaaccagcactgccacatatag

SEQ ID NO: 966190 - DNA, 25 bp, Mus musculus
tttcaaccagcagtgccacatatag

SEQ ID NO: 966191 - DNA, 25 bp, Mus musculus
tttcaaccagtactagtaacacaag

SEQ ID NO: 966192 - DNA, 25 bp, Mus musculus
tttcaaccagtagtagtaacacaag

SEQ ID NO: 966193 - DNA, 25 bp, Mus musculus
tttcaaccctctctgtgagctgcag

SEQ ID NO: 966194 - DNA, 25 bp, Mus musculus
tttcaaccctctgtgtgagctgcag

SEQ ID NO: 966195 - DNA, 25 bp, Mus musculus
tttcaaccgcctctgcctggagttt

SEQ ID NO: 966196 - DNA, 25 bp, Mus musculus
tttcaaccgcctgtgcctggagttt

SEQ ID NO: 966197 - DNA, 25 bp, Mus musculus
tttcaaccggctctagatgactacc

SEQ ID NO: 966198 - DNA, 25 bp, Mus musculus
tttcaaccggctgtagatgactacc

SEQ ID NO: 966199 - DNA, 25 bp, Mus musculus
tttcaacctacacatcctaacttat

SEQ ID NO: 966200 - DNA, 25 bp, Mus musculus
tttcaacctacagatcctaacttat

SEQ ID NO: 966201 - DNA, 25 bp, Mus musculus
tttcaacctatgacgacttgactgg

SEQ ID NO: 966202 - DNA, 25 bp, Mus musculus
tttcaacctatgtcgacttgactgg

SEQ ID NO: 966203 - DNA, 25 bp, Mus musculus
tttcaactaactagtcccggacaag

SEQ ID NO: 966204 - DNA, 25 bp, Mus musculus
tttcaactaacttgtcccggacaag

SEQ ID NO: 966205 - DNA, 25 bp, Mus musculus
tttcaactacttaatggtacagaca

SEQ ID NO: 966206 - DNA, 25 bp, Mus musculus
tttcaactactttatggtacagaca

SEQ ID NO: 966207 - DNA, 25 bp, Mus musculus
tttcaactagaactcctccagcagt

SEQ ID NO: 966208 - DNA, 25 bp, Mus musculus
tttcaactagaagtcctccagcagt

SEQ ID NO: 966209 - DNA, 25 bp, Mus musculus
tttcaactcattcggaagagctgca

SEQ ID NO: 966210 - DNA, 25 bp, Mus musculus
tttcaactcattgggaagagctgca

SEQ ID NO: 966211 - DNA, 25 bp, Mus musculus
tttcaactccacaggaacattccct

SEQ ID NO: 966212 - DNA, 25 bp, Mus musculus
tttcaactccactggaacattccct

SEQ ID NO: 966213 - DNA, 25 bp, Mus musculus
tttcaactcctcacatccttttagg

SEQ ID NO: 966214 - DNA, 25 bp, Mus musculus
tttcaactcctctcatccttttagg

SEQ ID NO: 966215 - DNA, 25 bp, Mus musculus
tttcaactggaaaatgttggctggt

SEQ ID NO: 966216 - DNA, 25 bp, Mus musculus
tttcaactggaatatgttggctggt

SEQ ID NO: 966217 - DNA, 25 bp, Mus musculus
tttcaacttgttacgatgctagcag

SEQ ID NO: 966218 - DNA, 25 bp, Mus musculus
tttcaacttgtttcgatgctagcag

SEQ ID NO: 966219 - DNA, 25 bp, Mus musculus
tttcaactttagctgatttattgcc

SEQ ID NO: 966220 - DNA, 25 bp, Mus musculus
tttcaactttaggtgatttattgcc

SEQ ID NO: 966221 - DNA, 25 bp, Mus musculus
tttcaagaaactaccgagtcctctc

SEQ ID NO: 966222 - DNA, 25 bp, Mus musculus
tttcaagaaacttccgagtcctctc

SEQ ID NO: 966223 - DNA, 25 bp, Mus musculus
tttcaagaaagccttgccagccctc

SEQ ID NO: 966224 - DNA, 25 bp, Mus musculus
tttcaagaaagcgttgccagccctc

SEQ ID NO: 966225 - DNA, 25 bp, Mus musculus
tttcaagaagagatccatatgctgg

SEQ ID NO: 966226 - DNA, 25 bp, Mus musculus
tttcaagaagagttccatatgctgg

SEQ ID NO: 966227 - DNA, 25 bp, Mus musculus
tttcaagaccgccagtggcacagtg

SEQ ID NO: 966228 - DNA, 25 bp, Mus musculus
tttcaagaccgcgagtggcacagtg

SEQ ID NO: 966229 - DNA, 25 bp, Mus musculus
tttcaagactctacagattgctgcc

SEQ ID NO: 966230 - DNA, 25 bp, Mus musculus
tttcaagactcttcagattgctgcc

SEQ ID NO: 966231 - DNA, 25 bp, Mus musculus
tttcaagagtgtatgaccacctact

SEQ ID NO: 966232 - DNA, 25 bp, Mus musculus
tttcaagagtgtttgaccacctact

SEQ ID NO: 966233 - DNA, 25 bp, Mus musculus
tttcaagataataagccaaggattc

SEQ ID NO: 966234 - DNA, 25 bp, Mus musculus
tttcaagataattagccaaggattc

SEQ ID NO: 966235 - DNA, 25 bp, Mus musculus
tttcaagatgagctttacccctcgg

SEQ ID NO: 966236 - DNA, 25 bp, Mus musculus
tttcaagatgaggtttacccctcgg

SEQ ID NO: 966237 - DNA, 25 bp, Mus musculus
tttcaagatggaccaacaccctgct

SEQ ID NO: 966238 - DNA, 25 bp, Mus musculus
tttcaagatggagcaacaccctgct

SEQ ID NO: 966239 - DNA, 25 bp, Mus musculus
tttcaagattttagaggctgccctc

SEQ ID NO: 966240 - DNA, 25 bp, Mus musculus
tttcaagatttttgaggctgccctc

SEQ ID NO: 966241 - DNA, 25 bp, Mus musculus
tttcaagcataccacgagggcaacg

SEQ ID NO: 966242 - DNA, 25 bp, Mus musculus
tttcaagcatacgacgagggcaacg

SEQ ID NO: 966243 - DNA, 25 bp, Mus musculus
tttcaagcccaacccgattcttagg

SEQ ID NO: 966244 - DNA, 25 bp, Mus musculus
tttcaagcccaagccgattcttagg

SEQ ID NO: 966245 - DNA, 25 bp, Mus musculus
tttcaagcgatccagccacctgtcg

SEQ ID NO: 966246 - DNA, 25 bp, Mus musculus
tttcaagcgatcgagccacctgtcg

SEQ ID NO: 966247 - DNA, 25 bp, Mus musculus
tttcaagctggcaccagaatccttg

SEQ ID NO: 966248 - DNA, 25 bp, Mus musculus
tttcaagctggctccagaatccttg

SEQ ID NO: 966249 - DNA, 25 bp, Mus musculus
tttcaagcttaaaacaccgtaacat

SEQ ID NO: 966250 - DNA, 25 bp, Mus musculus
tttcaagcttaatacaccgtaacat

SEQ ID NO: 966251 - DNA, 25 bp, Mus musculus
tttcaagcttcacatgttccgtgga

SEQ ID NO: 966252 - DNA, 25 bp, Mus musculus
tttcaagcttcagatgttccgtgga

SEQ ID NO: 966253 - DNA, 25 bp, Mus musculus
tttcaagcttccaacagtctccaaa

SEQ ID NO: 966254 - DNA, 25 bp, Mus musculus
tttcaagcttccctttgtgcagttt

SEQ ID NO: 966255 - DNA, 25 bp, Mus musculus
tttcaagcttccgtttgtgcagttt

SEQ ID NO: 966256 - DNA, 25 bp, Mus musculus
tttcaagcttcctacagtctccaaa

SEQ ID NO: 966257 - DNA, 25 bp, Mus musculus
tttcaagcttgcactctccggtagt

SEQ ID NO: 966258 - DNA, 25 bp, Mus musculus
tttcaagcttgctctctccggtagt

SEQ ID NO: 966259 - DNA, 25 bp, Mus musculus
tttcaagctttcctcagtggcaacc

SEQ ID NO: 966260 - DNA, 25 bp, Mus musculus
tttcaagctttcgtcagtggcaacc

SEQ ID NO: 966261 - DNA, 25 bp, Mus musculus
tttcaaggaaatacagggtctccga

SEQ ID NO: 966262 - DNA, 25 bp, Mus musculus
tttcaaggaaattcagggtctccga

SEQ ID NO: 966263 - DNA, 25 bp, Mus musculus
tttcaaggcccactctcagtcctga

SEQ ID NO: 966264 - DNA, 25 bp, Mus musculus
tttcaaggcccagtctcagtcctga

SEQ ID NO: 966265 - DNA, 25 bp, Mus musculus
tttcaaggccctaggacttcacaaa

SEQ ID NO: 966266 - DNA, 25 bp, Mus musculus
tttcaaggcccttggacttcacaaa

SEQ ID NO: 966267 - DNA, 25 bp, Mus musculus
tttcaaggcggtatcctgcactgaa

SEQ ID NO: 966268 - DNA, 25 bp, Mus musculus
tttcaaggcggtttcctgcactgaa

SEQ ID NO: 966269 - DNA, 25 bp, Mus musculus
tttcaaggctgtctcggctttcact

SEQ ID NO: 966270 - DNA, 25 bp, Mus musculus
tttcaaggctgtgtcggctttcact

SEQ ID NO: 966271 - DNA, 25 bp, Mus musculus
tttcaaggtacgaagcagaggccct

SEQ ID NO: 966272 - DNA, 25 bp, Mus musculus
tttcaaggtacgtagcagaggccct

SEQ ID NO: 966273 - DNA, 25 bp, Mus musculus
tttcaagtacccaaaacccatgctt

SEQ ID NO: 966274 - DNA, 25 bp, Mus musculus
tttcaagtaccctaaacccatgctt

SEQ ID NO: 966275 - DNA, 25 bp, Mus musculus
tttcaagtatccaggtttcaaacgg

SEQ ID NO: 966276 - DNA, 25 bp, Mus musculus
tttcaagtatcctggtttcaaacgg

SEQ ID NO: 966277 - DNA, 25 bp, Mus musculus
tttcaagtatggcagactctgggtt

SEQ ID NO: 966278 - DNA, 25 bp, Mus musculus
tttcaagtatgggagactctgggtt

SEQ ID NO: 966279 - DNA, 25 bp, Mus musculus
tttcaagtatttactaggccaggaa

SEQ ID NO: 966280 - DNA, 25 bp, Mus musculus
tttcaagtattttctaggccaggaa

SEQ ID NO: 966281 - DNA, 25 bp, Mus musculus
tttcaagtcctacagcctcttcaga

SEQ ID NO: 966282 - DNA, 25 bp, Mus musculus
tttcaagtcctagagcctcttcaga

SEQ ID NO: 966283 - DNA, 25 bp, Mus musculus
tttcaagtcgttaaaggcccattct

SEQ ID NO: 966284 - DNA, 25 bp, Mus musculus
tttcaagtcgtttaaggcccattct

SEQ ID NO: 966285 - DNA, 25 bp, Mus musculus
tttcaagtcttccaatactccattt

SEQ ID NO: 966286 - DNA, 25 bp, Mus musculus
tttcaagtcttcgaatactccattt

SEQ ID NO: 966287 - DNA, 25 bp, Mus musculus
tttcaagtgcagagctcttaagact

SEQ ID NO: 966288 - DNA, 25 bp, Mus musculus
tttcaagtgcagtgctcttaagact

SEQ ID NO: 966289 - DNA, 25 bp, Mus musculus
tttcaagtgcttacaactttgctgt

SEQ ID NO: 966290 - DNA, 25 bp, Mus musculus
tttcaagtgctttcaactttgctgt

SEQ ID NO: 966291 - DNA, 25 bp, Mus musculus
tttcaagtggttacaacatggagtt

SEQ ID NO: 966292 - DNA, 25 bp, Mus musculus
tttcaagtggtttcaacatggagtt

SEQ ID NO: 966293 - DNA, 25 bp, Mus musculus
tttcaagttctgacataccagtgtt

SEQ ID NO: 966294 - DNA, 25 bp, Mus musculus
tttcaagttctgtcataccagtgtt

SEQ ID NO: 966295 - DNA, 25 bp, Mus musculus
tttcaagttgtcctttcttcaccct

SEQ ID NO: 966296 - DNA, 25 bp, Mus musculus
tttcaagttgtcgtttcttcaccct

SEQ ID NO: 966297 - DNA, 25 bp, Mus musculus
tttcaagtttctaggcacacgtacg

SEQ ID NO: 966298 - DNA, 25 bp, Mus musculus
tttcaagtttcttggcacacgtacg

SEQ ID NO: 966299 - DNA, 25 bp, Mus musculus
tttcaagttttactgtggctgcatt

SEQ ID NO: 966300 - DNA, 25 bp, Mus musculus
tttcaagttttagtgtggctgcatt

SEQ ID NO: 966301 - DNA, 25 bp, Mus musculus
tttcaatacataacccagcctgcag

SEQ ID NO: 966302 - DNA, 25 bp, Mus musculus
tttcaatacatatcccagcctgcag

SEQ ID NO: 966303 - DNA, 25 bp, Mus musculus
tttcaatacccacatacctgacctg

SEQ ID NO: 966304 - DNA, 25 bp, Mus musculus
tttcaatacccagatacctgacctg

SEQ ID NO: 966305 - DNA, 25 bp, Mus musculus
tttcaatacctcattgtatttcccc

SEQ ID NO: 966306 - DNA, 25 bp, Mus musculus
tttcaatacctctttgtatttcccc

SEQ ID NO: 966307 - DNA, 25 bp, Mus musculus
tttcaatactgcattttggttggtt

SEQ ID NO: 966308 - DNA, 25 bp, Mus musculus
tttcaatactgctttttggttggtt

SEQ ID NO: 966309 - DNA, 25 bp, Mus musculus
tttcaatacttgatttgcccagttt

SEQ ID NO: 966310 - DNA, 25 bp, Mus musculus
tttcaatacttgttttgcccagttt

SEQ ID NO: 966311 - DNA, 25 bp, Mus musculus
tttcaatactttcctagcagaccag

SEQ ID NO: 966312 - DNA, 25 bp, Mus musculus
tttcaatactttgctagcagaccag

SEQ ID NO: 966313 - DNA, 25 bp, Mus musculus
tttcaatagggcactctgacctcag

SEQ ID NO: 966314 - DNA, 25 bp, Mus musculus
tttcaatagggcatctaagtccagt

SEQ ID NO: 966315 - DNA, 25 bp, Mus musculus
tttcaatagggctctctgacctcag

SEQ ID NO: 966316 - DNA, 25 bp, Mus musculus
tttcaatagggcttctaagtccagt

SEQ ID NO: 966317 - DNA, 25 bp, Mus musculus
tttcaatcaatgattgccactgtag

SEQ ID NO: 966318 - DNA, 25 bp, Mus musculus
tttcaatcaatgtttgccactgtag

SEQ ID NO: 966319 - DNA, 25 bp, Mus musculus
tttcaatcccagcatgcacttatta

SEQ ID NO: 966320 - DNA, 25 bp, Mus musculus
tttcaatcccaggatgcacttatta

SEQ ID NO: 966321 - DNA, 25 bp, Mus musculus
tttcaatcccttacctgacagagtt

SEQ ID NO: 966322 - DNA, 25 bp, Mus musculus
tttcaatccctttcctgacagagtt

SEQ ID NO: 966323 - DNA, 25 bp, Mus musculus
tttcaatcctgccaaagaactgatt

SEQ ID NO: 966324 - DNA, 25 bp, Mus musculus
tttcaatcctgcgaaagaactgatt

SEQ ID NO: 966325 - DNA, 25 bp, Mus musculus
tttcaatctaccatggcagctgctc

SEQ ID NO: 966326 - DNA, 25 bp, Mus musculus
tttcaatctaccttggcagctgctc

SEQ ID NO: 966327 - DNA, 25 bp, Mus musculus
tttcaatctcacaccaactaacttt

SEQ ID NO: 966328 - DNA, 25 bp, Mus musculus
tttcaatctcactccaactaacttt

SEQ ID NO: 966329 - DNA, 25 bp, Mus musculus
tttcaatctcgtactgttgtgacag

SEQ ID NO: 966330 - DNA, 25 bp, Mus musculus
tttcaatctcgttctgttgtgacag

SEQ ID NO: 966331 - DNA, 25 bp, Mus musculus
tttcaatctgtaatcactcgtagtg

SEQ ID NO: 966332 - DNA, 25 bp, Mus musculus
tttcaatctgtattcactcgtagtg

SEQ ID NO: 966333 - DNA, 25 bp, Mus musculus
tttcaatcttcaccaggccagatct

SEQ ID NO: 966334 - DNA, 25 bp, Mus musculus
tttcaatcttcagcaggccagatct

SEQ ID NO: 966335 - DNA, 25 bp, Mus musculus
tttcaatgactgctaaagatctgtg

SEQ ID NO: 966336 - DNA, 25 bp, Mus musculus
tttcaatgactggtaaagatctgtg

SEQ ID NO: 966337 - DNA, 25 bp, Mus musculus
tttcaatgccaccaacaaactatgt

SEQ ID NO: 966338 - DNA, 25 bp, Mus musculus
tttcaatgccacgaacaaactatgt

SEQ ID NO: 966339 - DNA, 25 bp, Mus musculus
tttcaatgtaggacgcacccggccg

SEQ ID NO: 966340 - DNA, 25 bp, Mus musculus
tttcaatgtaggtcgcacccggccg

SEQ ID NO: 966341 - DNA, 25 bp, Mus musculus
tttcaattcagtctaccagccttta

SEQ ID NO: 966342 - DNA, 25 bp, Mus musculus
tttcaattcagtgtaccagccttta

SEQ ID NO: 966343 - DNA, 25 bp, Mus musculus
tttcaattccagatctagagtcact

SEQ ID NO: 966344 - DNA, 25 bp, Mus musculus
tttcaattccagttctagagtcact

SEQ ID NO: 966345 - DNA, 25 bp, Mus musculus
tttcaattccatactgacccgcaat

SEQ ID NO: 966346 - DNA, 25 bp, Mus musculus
tttcaattccattctgacccgcaat

SEQ ID NO: 966347 - DNA, 25 bp, Mus musculus
tttcaattctgccatatttcatgtc

SEQ ID NO: 966348 - DNA, 25 bp, Mus musculus
tttcaattctgcgatatttcatgtc

SEQ ID NO: 966349 - DNA, 25 bp, Mus musculus
tttcaattctgtcggcccacgtgct

SEQ ID NO: 966350 - DNA, 25 bp, Mus musculus
tttcaattctgtgggcccacgtgct

SEQ ID NO: 966351 - DNA, 25 bp, Mus musculus
tttcaattgaagaggccagcaggca

SEQ ID NO: 966352 - DNA, 25 bp, Mus musculus
tttcaattgaagtggccagcaggca

SEQ ID NO: 966353 - DNA, 25 bp, Mus musculus
tttcaattgggaccaagcttttttg

SEQ ID NO: 966354 - DNA, 25 bp, Mus musculus
tttcaattgggagcaagcttttttg

SEQ ID NO: 966355 - DNA, 25 bp, Mus musculus
tttcaattgtcactcctttttatgg

SEQ ID NO: 966356 - DNA, 25 bp, Mus musculus
tttcaattgtcagtcctttttatgg

SEQ ID NO: 966357 - DNA, 25 bp, Mus musculus
tttcaatttgggagccctgtccgca

SEQ ID NO: 966358 - DNA, 25 bp, Mus musculus
tttcaatttgggtgccctgtccgca

SEQ ID NO: 966359 - DNA, 25 bp, Mus musculus
tttcacaaacagatgttcccctgat

SEQ ID NO: 966360 - DNA, 25 bp, Mus musculus
tttcacaaacagttgttcccctgat

SEQ ID NO: 966361 - DNA, 25 bp, Mus musculus
tttcacaaatgaacagcgcccacaa

SEQ ID NO: 966362 - DNA, 25 bp, Mus musculus
tttcacaaatgatcagcgcccacaa

SEQ ID NO: 966363 - DNA, 25 bp, Mus musculus
tttcacaaatggcagacttgaagat

SEQ ID NO: 966364 - DNA, 25 bp, Mus musculus
tttcacaaatgggagacttgaagat

SEQ ID NO: 966365 - DNA, 25 bp, Mus musculus
tttcacacaatgcagcgcaacaatg

SEQ ID NO: 966366 - DNA, 25 bp, Mus musculus
tttcacacaatggagcgcaacaatg

SEQ ID NO: 966367 - DNA, 25 bp, Mus musculus
tttcacacaattacaaatatgacag

SEQ ID NO: 966368 - DNA, 25 bp, Mus musculus
tttcacacaatttcaaatatgacag

SEQ ID NO: 966369 - DNA, 25 bp, Mus musculus
tttcacacagtgctatttcggcgcc

SEQ ID NO: 966370 - DNA, 25 bp, Mus musculus
tttcacacagtggtatttcggcgcc

SEQ ID NO: 966371 - DNA, 25 bp, Mus musculus
tttcacacctgcactggaagtcctt

SEQ ID NO: 966372 - DNA, 25 bp, Mus musculus
tttcacacctgctctggaagtcctt

SEQ ID NO: 966373 - DNA, 25 bp, Mus musculus
tttcacaccttaaacctgcttcaat

SEQ ID NO: 966374 - DNA, 25 bp, Mus musculus
tttcacaccttatacctgcttcaat

SEQ ID NO: 966375 - DNA, 25 bp, Mus musculus
tttcacacttgaaagcagctgccat

SEQ ID NO: 966376 - DNA, 25 bp, Mus musculus
tttcacacttgatagcagctgccat

SEQ ID NO: 966377 - DNA, 25 bp, Mus musculus
tttcacacttggaagacctcccgct

SEQ ID NO: 966378 - DNA, 25 bp, Mus musculus
tttcacacttggtagacctcccgct

SEQ ID NO: 966379 - DNA, 25 bp, Mus musculus
tttcacagaactagacccccgagat

SEQ ID NO: 966380 - DNA, 25 bp, Mus musculus
tttcacagaacttgacccccgagat

SEQ ID NO: 966381 - DNA, 25 bp, Mus musculus
tttcacagaagcatcgttagcccaa

SEQ ID NO: 966382 - DNA, 25 bp, Mus musculus
tttcacagaagcttcgttagcccaa

SEQ ID NO: 966383 - DNA, 25 bp, Mus musculus
tttcacagcaggactttgactccca

SEQ ID NO: 966384 - DNA, 25 bp, Mus musculus
tttcacagcaggtctttgactccca

SEQ ID NO: 966385 - DNA, 25 bp, Mus musculus
tttcacagcatacctccaggcagct

SEQ ID NO: 966386 - DNA, 25 bp, Mus musculus
tttcacagcatagctccaggcagct

SEQ ID NO: 966387 - DNA, 25 bp, Mus musculus
tttcacagccctaagaatgagtctc

SEQ ID NO: 966388 - DNA, 25 bp, Mus musculus
tttcacagcccttagaatgagtctc

SEQ ID NO: 966389 - DNA, 25 bp, Mus musculus
tttcacagcctgcaagtcatcgttg

SEQ ID NO: 966390 - DNA, 25 bp, Mus musculus
tttcacagcctggaagtcatcgttg

SEQ ID NO: 966391 - DNA, 25 bp, Mus musculus
tttcacaggttcaccttcttcatca

SEQ ID NO: 966392 - DNA, 25 bp, Mus musculus
tttcacaggttctccttcttcatca

SEQ ID NO: 966393 - DNA, 25 bp, Mus musculus
tttcacagtcacagcccaatgactt

SEQ ID NO: 966394 - DNA, 25 bp, Mus musculus
tttcacagtcactgcccaatgactt

SEQ ID NO: 966395 - DNA, 25 bp, Mus musculus
tttcacagtgagaggtagtcactcc

SEQ ID NO: 966396 - DNA, 25 bp, Mus musculus
tttcacagtgagtggtagtcactcc

SEQ ID NO: 966397 - DNA, 25 bp, Mus musculus
tttcacagtgatcgctttgtctcat

SEQ ID NO: 966398 - DNA, 25 bp, Mus musculus
tttcacagtgatggctttgtctcat

SEQ ID NO: 966399 - DNA, 25 bp, Mus musculus
tttcacagtgtgctaaaacaaccaa

SEQ ID NO: 966400 - DNA, 25 bp, Mus musculus
tttcacagtgtggtaaaacaaccaa

SEQ ID NO: 966401 - DNA, 25 bp, Mus musculus
tttcacagtttcccaccctaacaag

SEQ ID NO: 966402 - DNA, 25 bp, Mus musculus
tttcacagtttcgcaccctaacaag

SEQ ID NO: 966403 - DNA, 25 bp, Mus musculus
tttcacataattcaagacacccacc

SEQ ID NO: 966404 - DNA, 25 bp, Mus musculus
tttcacataattgaagacacccacc

SEQ ID NO: 966405 - DNA, 25 bp, Mus musculus
tttcacatactgatagtaggtatag

SEQ ID NO: 966406 - DNA, 25 bp, Mus musculus
tttcacatactgttagtaggtatag

SEQ ID NO: 966407 - DNA, 25 bp, Mus musculus
tttcacatcctaagggctggcccac

SEQ ID NO: 966408 - DNA, 25 bp, Mus musculus
tttcacatcctatgggctggcccac

SEQ ID NO: 966409 - DNA, 25 bp, Mus musculus
tttcacatcctccaaccctaaattt

SEQ ID NO: 966410 - DNA, 25 bp, Mus musculus
tttcacatcctcgaaccctaaattt

SEQ ID NO: 966411 - DNA, 25 bp, Mus musculus
tttcacatgcaaagatggcaagcct

SEQ ID NO: 966412 - DNA, 25 bp, Mus musculus
tttcacatgcaatgatggcaagcct

SEQ ID NO: 966413 - DNA, 25 bp, Mus musculus
tttcacatgcagattatcacttatt

SEQ ID NO: 966414 - DNA, 25 bp, Mus musculus
tttcacatgcagtttatcacttatt

SEQ ID NO: 966415 - DNA, 25 bp, Mus musculus
tttcacatgggaatccaggactgta

SEQ ID NO: 966416 - DNA, 25 bp, Mus musculus
tttcacatgggattccaggactgta

SEQ ID NO: 966417 - DNA, 25 bp, Mus musculus
tttcacatgtggaagcttttaattg

SEQ ID NO: 966418 - DNA, 25 bp, Mus musculus
tttcacatgtggtagcttttaattg

SEQ ID NO: 966419 - DNA, 25 bp, Mus musculus
tttcacattaaccatcagcagcctg

SEQ ID NO: 966420 - DNA, 25 bp, Mus musculus
tttcacattaacgatcagcagcctg

SEQ ID NO: 966421 - DNA, 25 bp, Mus musculus
tttcacattactacatccacatggc

SEQ ID NO: 966422 - DNA, 25 bp, Mus musculus
tttcacattacttcatccacatggc

SEQ ID NO: 966423 - DNA, 25 bp, Mus musculus
tttcacattccaactttgctatctg

SEQ ID NO: 966424 - DNA, 25 bp, Mus musculus
tttcacattccatctttgctatctg

SEQ ID NO: 966425 - DNA, 25 bp, Mus musculus
tttcacattgagattctttttgctg

SEQ ID NO: 966426 - DNA, 25 bp, Mus musculus
tttcacattgagtttctttttgctg

SEQ ID NO: 966427 - DNA, 25 bp, Mus musculus
tttcacatttccaaggctcatcaac

SEQ ID NO: 966428 - DNA, 25 bp, Mus musculus
tttcacatttcctaggctcatcaac

SEQ ID NO: 966429 - DNA, 25 bp, Mus musculus
tttcacatttggcactatcaatcag

SEQ ID NO: 966430 - DNA, 25 bp, Mus musculus
tttcacatttgggactatcaatcag

SEQ ID NO: 966431 - DNA, 25 bp, Mus musculus
tttcaccaagaccactactttctga

SEQ ID NO: 966432 - DNA, 25 bp, Mus musculus
tttcaccaagacgactactttctga

SEQ ID NO: 966433 - DNA, 25 bp, Mus musculus
tttcaccaagagatctccaaggttt

SEQ ID NO: 966434 - DNA, 25 bp, Mus musculus
tttcaccaagagttctccaaggttt

SEQ ID NO: 966435 - DNA, 25 bp, Mus musculus
tttcaccaagctagcatcagctaca

SEQ ID NO: 966436 - DNA, 25 bp, Mus musculus
tttcaccaagcttgcatcagctaca

SEQ ID NO: 966437 - DNA, 25 bp, Mus musculus
tttcaccaattgaggccactcatgt

SEQ ID NO: 966438 - DNA, 25 bp, Mus musculus
tttcaccaattgtggccactcatgt

SEQ ID NO: 966439 - DNA, 25 bp, Mus musculus
tttcaccacattaactctgttaaga

SEQ ID NO: 966440 - DNA, 25 bp, Mus musculus
tttcaccacatttactctgttaaga

SEQ ID NO: 966441 - DNA, 25 bp, Mus musculus
tttcaccagaatagcattgttatgt

SEQ ID NO: 966442 - DNA, 25 bp, Mus musculus
tttcaccagaattgcattgttatgt

SEQ ID NO: 966443 - DNA, 25 bp, Mus musculus
tttcaccagatgagattctgttctg

SEQ ID NO: 966444 - DNA, 25 bp, Mus musculus
tttcaccagatgtgattctgttctg

SEQ ID NO: 966445 - DNA, 25 bp, Mus musculus
tttcaccagcacagcatacatgggt

SEQ ID NO: 966446 - DNA, 25 bp, Mus musculus
tttcaccagcactgcatacatgggt

SEQ ID NO: 966447 - DNA, 25 bp, Mus musculus
tttcaccagcctatccagcaggttt

SEQ ID NO: 966448 - DNA, 25 bp, Mus musculus
tttcaccagcctttccagcaggttt

SEQ ID NO: 966449 - DNA, 25 bp, Mus musculus
tttcaccagcggcaagggcttgcgg

SEQ ID NO: 966450 - DNA, 25 bp, Mus musculus
tttcaccagcgggaagggcttgcgg

SEQ ID NO: 966451 - DNA, 25 bp, Mus musculus
tttcaccagtgtatcagcccttgac

SEQ ID NO: 966452 - DNA, 25 bp, Mus musculus
tttcaccagtgtttcagcccttgac

SEQ ID NO: 966453 - DNA, 25 bp, Mus musculus
tttcaccatacacattgagcctgca

SEQ ID NO: 966454 - DNA, 25 bp, Mus musculus
tttcaccatacagattgagcctgca

SEQ ID NO: 966455 - DNA, 25 bp, Mus musculus
tttcaccatctgattattaatgtaa

SEQ ID NO: 966456 - DNA, 25 bp, Mus musculus
tttcaccatctgtttattaatgtaa

SEQ ID NO: 966457 - DNA, 25 bp, Mus musculus
tttcaccatggaatgctttgcgcac

SEQ ID NO: 966458 - DNA, 25 bp, Mus musculus
tttcaccatggattgctttgcgcac

SEQ ID NO: 966459 - DNA, 25 bp, Mus musculus
tttcacccactcaaaatggaaaatg

SEQ ID NO: 966460 - DNA, 25 bp, Mus musculus
tttcacccactctaaatggaaaatg

SEQ ID NO: 966461 - DNA, 25 bp, Mus musculus
tttcacccagaaccaggtcgaagta

SEQ ID NO: 966462 - DNA, 25 bp, Mus musculus
tttcacccagaagcaggtcgaagta

SEQ ID NO: 966463 - DNA, 25 bp, Mus musculus
tttcacccattaattcagccaatct

SEQ ID NO: 966464 - DNA, 25 bp, Mus musculus
tttcacccattatttcagccaatct

SEQ ID NO: 966465 - DNA, 25 bp, Mus musculus
tttcaccccaaaacttaagcttgca

SEQ ID NO: 966466 - DNA, 25 bp, Mus musculus
tttcaccccaaaagaccaagagcct

SEQ ID NO: 966467 - DNA, 25 bp, Mus musculus
tttcaccccaaatcttaagcttgca

SEQ ID NO: 966468 - DNA, 25 bp, Mus musculus
tttcaccccaaatgaccaagagcct

SEQ ID NO: 966469 - DNA, 25 bp, Mus musculus
tttcaccccaataccttgttcagaa

SEQ ID NO: 966470 - DNA, 25 bp, Mus musculus
tttcaccccaattccttgttcagaa

SEQ ID NO: 966471 - DNA, 25 bp, Mus musculus
tttcacccggatcaacgtgtgtcaa

SEQ ID NO: 966472 - DNA, 25 bp, Mus musculus
tttcacccggatgaacgtgtgtcaa

SEQ ID NO: 966473 - DNA, 25 bp, Mus musculus
tttcacccgtctcctttctggaaaa

SEQ ID NO: 966474 - DNA, 25 bp, Mus musculus
tttcacccgtctgctttctggaaaa

SEQ ID NO: 966475 - DNA, 25 bp, Mus musculus
tttcaccctgttacttcgagtaaat

SEQ ID NO: 966476 - DNA, 25 bp, Mus musculus
tttcaccctgttcagttgacacatg

SEQ ID NO: 966477 - DNA, 25 bp, Mus musculus
tttcaccctgttgagttgacacatg

SEQ ID NO: 966478 - DNA, 25 bp, Mus musculus
tttcaccctgtttcttcgagtaaat

SEQ ID NO: 966479 - DNA, 25 bp, Mus musculus
tttcaccgaattctagcgtccccag

SEQ ID NO: 966480 - DNA, 25 bp, Mus musculus
tttcaccgaattgtagcgtccccag

SEQ ID NO: 966481 - DNA, 25 bp, Mus musculus
tttcaccggtgaccctatagcctgt

SEQ ID NO: 966482 - DNA, 25 bp, Mus musculus
tttcaccggtgagcctatagcctgt

SEQ ID NO: 966483 - DNA, 25 bp, Mus musculus
tttcacctaaagatagtttctgagt

SEQ ID NO: 966484 - DNA, 25 bp, Mus musculus
tttcacctaaagttagtttctgagt

SEQ ID NO: 966485 - DNA, 25 bp, Mus musculus
tttcacctacttacacatgatcctt

SEQ ID NO: 966486 - DNA, 25 bp, Mus musculus
tttcacctactttcacatgatcctt

SEQ ID NO: 966487 - DNA, 25 bp, Mus musculus
tttcacctagcgataatcatctgac

SEQ ID NO: 966488 - DNA, 25 bp, Mus musculus
tttcacctagcgttaatcatctgac

SEQ ID NO: 966489 - DNA, 25 bp, Mus musculus
tttcacctagtccagaatgctctac

SEQ ID NO: 966490 - DNA, 25 bp, Mus musculus
tttcacctagtcgagaatgctctac

SEQ ID NO: 966491 - DNA, 25 bp, Mus musculus
tttcacctctggctgtatacttaag

SEQ ID NO: 966492 - DNA, 25 bp, Mus musculus
tttcacctctgggtgtatacttaag

SEQ ID NO: 966493 - DNA, 25 bp, Mus musculus
tttcacctgaaaagtcccgcgaagg

SEQ ID NO: 966494 - DNA, 25 bp, Mus musculus
tttcacctgaaatgtcccgcgaagg

SEQ ID NO: 966495 - DNA, 25 bp, Mus musculus
tttcacctgatcacatatttaatca

SEQ ID NO: 966496 - DNA, 25 bp, Mus musculus
tttcacctgatctcatatttaatca

SEQ ID NO: 966497 - DNA, 25 bp, Mus musculus
tttcacctgatgcaacactacccag

SEQ ID NO: 966498 - DNA, 25 bp, Mus musculus
tttcacctgatggaacactacccag

SEQ ID NO: 966499 - DNA, 25 bp, Mus musculus
tttcacctgccaatcagctgttaat

SEQ ID NO: 966500 - DNA, 25 bp, Mus musculus
tttcacctgccattcagctgttaat

SEQ ID NO: 966501 - DNA, 25 bp, Mus musculus
tttcacctgctcagtgttacatgag

SEQ ID NO: 966502 - DNA, 25 bp, Mus musculus
tttcacctgctctgtgttacatgag

SEQ ID NO: 966503 - DNA, 25 bp, Mus musculus
tttcacctggaaagctggcccaaat

SEQ ID NO: 966504 - DNA, 25 bp, Mus musculus
tttcacctggaatgctggcccaaat

SEQ ID NO: 966505 - DNA, 25 bp, Mus musculus
tttcacctggcaatgtactgtatca

SEQ ID NO: 966506 - DNA, 25 bp, Mus musculus
tttcacctggcattgtactgtatca

SEQ ID NO: 966507 - DNA, 25 bp, Mus musculus
tttcacctgtctcatgcttgggcta

SEQ ID NO: 966508 - DNA, 25 bp, Mus musculus
tttcacctgtctgatgcttgggcta

SEQ ID NO: 966509 - DNA, 25 bp, Mus musculus
tttcacctgtgaccactttgacgga

SEQ ID NO: 966510 - DNA, 25 bp, Mus musculus
tttcacctgtgagcactttgacgga

SEQ ID NO: 966511 - DNA, 25 bp, Mus musculus
tttcacctgtgcctctattattatg

SEQ ID NO: 966512 - DNA, 25 bp, Mus musculus
tttcacctgtgcgtctattattatg

SEQ ID NO: 966513 - DNA, 25 bp, Mus musculus
tttcaccttaaaattgttcattaga

SEQ ID NO: 966514 - DNA, 25 bp, Mus musculus
tttcaccttaaatttgttcattaga

SEQ ID NO: 966515 - DNA, 25 bp, Mus musculus
tttcaccttccaatcctgattttag

SEQ ID NO: 966516 - DNA, 25 bp, Mus musculus
tttcaccttccattcctgattttag

SEQ ID NO: 966517 - DNA, 25 bp, Mus musculus
tttcacctttgtaatctggtccagg

SEQ ID NO: 966518 - DNA, 25 bp, Mus musculus
tttcacctttgttatctggtccagg

SEQ ID NO: 966519 - DNA, 25 bp, Mus musculus
tttcacgaactgacctggctttggt

SEQ ID NO: 966520 - DNA, 25 bp, Mus musculus
tttcacgaactgtcctggctttggt

SEQ ID NO: 966521 - DNA, 25 bp, Mus musculus
tttcacgaagggaccagcttttcag

SEQ ID NO: 966522 - DNA, 25 bp, Mus musculus
tttcacgaagggtccagcttttcag

SEQ ID NO: 966523 - DNA, 25 bp, Mus musculus
tttcacgccagcaaatttcttgacc

SEQ ID NO: 966524 - DNA, 25 bp, Mus musculus
tttcacgccagctaatttcttgacc

SEQ ID NO: 966525 - DNA, 25 bp, Mus musculus
tttcacgctcgcatgctaaagaggt

SEQ ID NO: 966526 - DNA, 25 bp, Mus musculus
tttcacgctcgcttgctaaagaggt

SEQ ID NO: 966527 - DNA, 25 bp, Mus musculus
tttcacggccttacagacatccttg

SEQ ID NO: 966528 - DNA, 25 bp, Mus musculus
tttcacggcctttcagacatccttg

SEQ ID NO: 966529 - DNA, 25 bp, Mus musculus
tttcacgggccaatgagtttactca

SEQ ID NO: 966530 - DNA, 25 bp, Mus musculus
tttcacgggccattgagtttactca

SEQ ID NO: 966531 - DNA, 25 bp, Mus musculus
tttcacgtacgcctttctctctaag

SEQ ID NO: 966532 - DNA, 25 bp, Mus musculus
tttcacgtacgcgtttctctctaag

SEQ ID NO: 966533 - DNA, 25 bp, Mus musculus
tttcacgtatgaacaggaagccaag

SEQ ID NO: 966534 - DNA, 25 bp, Mus musculus
tttcacgtatgatcaggaagccaag

SEQ ID NO: 966535 - DNA, 25 bp, Mus musculus
tttcacgtcaacaacggtgccggaa

SEQ ID NO: 966536 - DNA, 25 bp, Mus musculus
tttcacgtcaactacggtgccggaa

SEQ ID NO: 966537 - DNA, 25 bp, Mus musculus
tttcacgtttgtaagcatgcagctt

SEQ ID NO: 966538 - DNA, 25 bp, Mus musculus
tttcacgtttgttagcatgcagctt

SEQ ID NO: 966539 - DNA, 25 bp, Mus musculus
tttcactaatatatcttttggatcc

SEQ ID NO: 966540 - DNA, 25 bp, Mus musculus
tttcactaatatttcttttggatcc

SEQ ID NO: 966541 - DNA, 25 bp, Mus musculus
tttcactacagaatttttcatcttg

SEQ ID NO: 966542 - DNA, 25 bp, Mus musculus
tttcactacagattttttcatcttg

SEQ ID NO: 966543 - DNA, 25 bp, Mus musculus
tttcactaccacattggtgatgcag

SEQ ID NO: 966544 - DNA, 25 bp, Mus musculus
tttcactaccactttggtgatgcag

SEQ ID NO: 966545 - DNA, 25 bp, Mus musculus
tttcactcagagagggagcctggct

SEQ ID NO: 966546 - DNA, 25 bp, Mus musculus
tttcactcagagtgggagcctggct

SEQ ID NO: 966547 - DNA, 25 bp, Mus musculus
tttcactcaggactgctcacatcac

SEQ ID NO: 966548 - DNA, 25 bp, Mus musculus
tttcactcaggagtgctcacatcac

SEQ ID NO: 966549 - DNA, 25 bp, Mus musculus
tttcactccccaaacattccatgaa

SEQ ID NO: 966550 - DNA, 25 bp, Mus musculus
tttcactccccatacattccatgaa

SEQ ID NO: 966551 - DNA, 25 bp, Mus musculus
tttcactccgagacaaagaactgca

SEQ ID NO: 966552 - DNA, 25 bp, Mus musculus
tttcactccgagtcaaagaactgca

SEQ ID NO: 966553 - DNA, 25 bp, Mus musculus
tttcactcctaaattacccagcttt

SEQ ID NO: 966554 - DNA, 25 bp, Mus musculus
tttcactcctaatttacccagcttt

SEQ ID NO: 966555 - DNA, 25 bp, Mus musculus
tttcactctcagaatctggaggtga

SEQ ID NO: 966556 - DNA, 25 bp, Mus musculus
tttcactctcagtatctggaggtga

SEQ ID NO: 966557 - DNA, 25 bp, Mus musculus
tttcactctccgaggaaagccgtga

SEQ ID NO: 966558 - DNA, 25 bp, Mus musculus
tttcactctccgtggaaagccgtga

SEQ ID NO: 966559 - DNA, 25 bp, Mus musculus
tttcactcttcccattcacaaggtt

SEQ ID NO: 966560 - DNA, 25 bp, Mus musculus
tttcactcttccgattcacaaggtt

SEQ ID NO: 966561 - DNA, 25 bp, Mus musculus
tttcactcttgtacatgcatgtgag

SEQ ID NO: 966562 - DNA, 25 bp, Mus musculus
tttcactcttgttcatgcatgtgag

SEQ ID NO: 966563 - DNA, 25 bp, Mus musculus
tttcactgaaacactgcagcaatca

SEQ ID NO: 966564 - DNA, 25 bp, Mus musculus
tttcactgaaactctgcagcaatca

SEQ ID NO: 966565 - DNA, 25 bp, Mus musculus
tttcactgaaatcactccaagcctg

SEQ ID NO: 966566 - DNA, 25 bp, Mus musculus
tttcactgaaatgactccaagcctg

SEQ ID NO: 966567 - DNA, 25 bp, Mus musculus
tttcactgacttctggcagcctggg

SEQ ID NO: 966568 - DNA, 25 bp, Mus musculus
tttcactgacttgtggcagcctggg

SEQ ID NO: 966569 - DNA, 25 bp, Mus musculus
tttcactgagaaagtaggcacctgt

SEQ ID NO: 966570 - DNA, 25 bp, Mus musculus
tttcactgagaatgtaggcacctgt

SEQ ID NO: 966571 - DNA, 25 bp, Mus musculus
tttcactgataaatgatcgctgcaa

SEQ ID NO: 966572 - DNA, 25 bp, Mus musculus
tttcactgataattgatcgctgcaa

SEQ ID NO: 966573 - DNA, 25 bp, Mus musculus
tttcactgcgtaatggatattccaa

SEQ ID NO: 966574 - DNA, 25 bp, Mus musculus
tttcactgcgtattggatattccaa

SEQ ID NO: 966575 - DNA, 25 bp, Mus musculus
tttcactggcacaagagccttttgt

SEQ ID NO: 966576 - DNA, 25 bp, Mus musculus
tttcactggcactagagccttttgt

SEQ ID NO: 966577 - DNA, 25 bp, Mus musculus
tttcactggctcaacggcaaaacaa

SEQ ID NO: 966578 - DNA, 25 bp, Mus musculus
tttcactggctctacggcaaaacaa

SEQ ID NO: 966579 - DNA, 25 bp, Mus musculus
tttcactgggcaaatataccacatt

SEQ ID NO: 966580 - DNA, 25 bp, Mus musculus
tttcactgggcatatataccacatt

SEQ ID NO: 966581 - DNA, 25 bp, Mus musculus
tttcactgtgctagaaattagcatt

SEQ ID NO: 966582 - DNA, 25 bp, Mus musculus
tttcactgtgcttgaaattagcatt

SEQ ID NO: 966583 - DNA, 25 bp, Mus musculus
tttcactgtggcatggcaccccaag

SEQ ID NO: 966584 - DNA, 25 bp, Mus musculus
tttcactgtggcttggcaccccaag

SEQ ID NO: 966585 - DNA, 25 bp, Mus musculus
tttcactgtgtcctccatgcatgga

SEQ ID NO: 966586 - DNA, 25 bp, Mus musculus
tttcactgtgtcgtccatgcatgga

SEQ ID NO: 966587 - DNA, 25 bp, Mus musculus
tttcactgtgtgaggtcttggctat

SEQ ID NO: 966588 - DNA, 25 bp, Mus musculus
tttcactgtgtgcaggaggctgggc

SEQ ID NO: 966589 - DNA, 25 bp, Mus musculus
tttcactgtgtggaggaggctgggc

SEQ ID NO: 966590 - DNA, 25 bp, Mus musculus
tttcactgtgtgtggtcttggctat

SEQ ID NO: 966591 - DNA, 25 bp, Mus musculus
tttcactgttaacttataggcctgt

SEQ ID NO: 966592 - DNA, 25 bp, Mus musculus
tttcactgttaagttataggcctgt

SEQ ID NO: 966593 - DNA, 25 bp, Mus musculus
tttcacttagagactagcacccagt

SEQ ID NO: 966594 - DNA, 25 bp, Mus musculus
tttcacttagagtctagcacccagt

SEQ ID NO: 966595 - DNA, 25 bp, Mus musculus
tttcacttatctcgacagtcacccg

SEQ ID NO: 966596 - DNA, 25 bp, Mus musculus
tttcacttatctggacagtcacccg

SEQ ID NO: 966597 - DNA, 25 bp, Mus musculus
tttcacttcagcacttacaccttag

SEQ ID NO: 966598 - DNA, 25 bp, Mus musculus
tttcacttcagctcttacaccttag

SEQ ID NO: 966599 - DNA, 25 bp, Mus musculus
tttcacttcgaaaggacgctgttat

SEQ ID NO: 966600 - DNA, 25 bp, Mus musculus
tttcacttcgaatggacgctgttat

SEQ ID NO: 966601 - DNA, 25 bp, Mus musculus
tttcacttctcaccataacaatcac

SEQ ID NO: 966602 - DNA, 25 bp, Mus musculus
tttcacttctcagcataacaatcac

SEQ ID NO: 966603 - DNA, 25 bp, Mus musculus
tttcacttctggcatagatccaact

SEQ ID NO: 966604 - DNA, 25 bp, Mus musculus
tttcacttctgggatagatccaact

SEQ ID NO: 966605 - DNA, 25 bp, Mus musculus
tttcacttcttccaggctaggacgt

SEQ ID NO: 966606 - DNA, 25 bp, Mus musculus
tttcacttcttcgaggctaggacgt

SEQ ID NO: 966607 - DNA, 25 bp, Mus musculus
tttcacttgcataagagcttacata

SEQ ID NO: 966608 - DNA, 25 bp, Mus musculus
tttcacttgcattagagcttacata

SEQ ID NO: 966609 - DNA, 25 bp, Mus musculus
tttcacttgtggcattctttgctac

SEQ ID NO: 966610 - DNA, 25 bp, Mus musculus
tttcacttgtgggattctttgctac

SEQ ID NO: 966611 - DNA, 25 bp, Mus musculus
tttcacttgtgtattctctactctg

SEQ ID NO: 966612 - DNA, 25 bp, Mus musculus
tttcacttgtgttttctctactctg

SEQ ID NO: 966613 - DNA, 25 bp, Mus musculus
tttcactttacaatccaataccacc

SEQ ID NO: 966614 - DNA, 25 bp, Mus musculus
tttcactttacattccaataccacc

SEQ ID NO: 966615 - DNA, 25 bp, Mus musculus
tttcactttcttacccgctttcgct

SEQ ID NO: 966616 - DNA, 25 bp, Mus musculus
tttcactttctttcccgctttcgct

SEQ ID NO: 966617 - DNA, 25 bp, Mus musculus
tttcactttgggaaacatgtttgta

SEQ ID NO: 966618 - DNA, 25 bp, Mus musculus
tttcactttgggtaacatgtttgta

SEQ ID NO: 966619 - DNA, 25 bp, Mus musculus
tttcacttttgtcctttcgtgcatt

SEQ ID NO: 966620 - DNA, 25 bp, Mus musculus
tttcacttttgtgctttcgtgcatt

SEQ ID NO: 966621 - DNA, 25 bp, Mus musculus
tttcagaaactaatgattccacgtt

SEQ ID NO: 966622 - DNA, 25 bp, Mus musculus
tttcagaaactattgattccacgtt

SEQ ID NO: 966623 - DNA, 25 bp, Mus musculus
tttcagaaagaccagactcgtggct

SEQ ID NO: 966624 - DNA, 25 bp, Mus musculus
tttcagaaagacgagactcgtggct

SEQ ID NO: 966625 - DNA, 25 bp, Mus musculus
tttcagaaaggcctctgcgcataac

SEQ ID NO: 966626 - DNA, 25 bp, Mus musculus
tttcagaaaggcgtctgcgcataac

SEQ ID NO: 966627 - DNA, 25 bp, Mus musculus
tttcagaactcccactggccagtgc

SEQ ID NO: 966628 - DNA, 25 bp, Mus musculus
tttcagaactccgactggccagtgc

SEQ ID NO: 966629 - DNA, 25 bp, Mus musculus
tttcagaacttcagggtagcactta

SEQ ID NO: 966630 - DNA, 25 bp, Mus musculus
tttcagaacttctgggtagcactta

SEQ ID NO: 966631 - DNA, 25 bp, Mus musculus
tttcagaagaaccacgaggctctgg

SEQ ID NO: 966632 - DNA, 25 bp, Mus musculus
tttcagaagaacgacgaggctctgg

SEQ ID NO: 966633 - DNA, 25 bp, Mus musculus
tttcagaagttcctaagttatgcgg

SEQ ID NO: 966634 - DNA, 25 bp, Mus musculus
tttcagaagttcgtaagttatgcgg

SEQ ID NO: 966635 - DNA, 25 bp, Mus musculus
tttcagaatcctctgtgtcagccag

SEQ ID NO: 966636 - DNA, 25 bp, Mus musculus
tttcagaatcctgtgtgtcagccag

SEQ ID NO: 966637 - DNA, 25 bp, Mus musculus
tttcagaattccacctgttgtggga

SEQ ID NO: 966638 - DNA, 25 bp, Mus musculus
tttcagaattcctcctgttgtggga

SEQ ID NO: 966639 - DNA, 25 bp, Mus musculus
tttcagacaactattcctacacttt

SEQ ID NO: 966640 - DNA, 25 bp, Mus musculus
tttcagacaacttttcctacacttt

SEQ ID NO: 966641 - DNA, 25 bp, Mus musculus
tttcagacagaccttatggcctcgt

SEQ ID NO: 966642 - DNA, 25 bp, Mus musculus
tttcagacagacgttatggcctcgt

SEQ ID NO: 966643 - DNA, 25 bp, Mus musculus
tttcagacagggacaccagatgcct

SEQ ID NO: 966644 - DNA, 25 bp, Mus musculus
tttcagacagggtcaccagatgcct

SEQ ID NO: 966645 - DNA, 25 bp, Mus musculus
tttcagacaggtatggcgaccggct

SEQ ID NO: 966646 - DNA, 25 bp, Mus musculus
tttcagacaggtttggcgaccggct

SEQ ID NO: 966647 - DNA, 25 bp, Mus musculus
tttcagacattgaggcttgtttgta

SEQ ID NO: 966648 - DNA, 25 bp, Mus musculus
tttcagacattgtggcttgtttgta

SEQ ID NO: 966649 - DNA, 25 bp, Mus musculus
tttcagacccatctgaatcacgtcc

SEQ ID NO: 966650 - DNA, 25 bp, Mus musculus
tttcagacccatgtgaatcacgtcc

SEQ ID NO: 966651 - DNA, 25 bp, Mus musculus
tttcagacctgactggcatagttgt

SEQ ID NO: 966652 - DNA, 25 bp, Mus musculus
tttcagacctgagtggcatagttgt

SEQ ID NO: 966653 - DNA, 25 bp, Mus musculus
tttcagaccttcaagctggtacaga

SEQ ID NO: 966654 - DNA, 25 bp, Mus musculus
tttcagaccttctagctggtacaga

SEQ ID NO: 966655 - DNA, 25 bp, Mus musculus
tttcagacgagcactgccagctggg

SEQ ID NO: 966656 - DNA, 25 bp, Mus musculus
tttcagacgagctctgccagctggg

SEQ ID NO: 966657 - DNA, 25 bp, Mus musculus
tttcagacgcgtagcctggtcccct

SEQ ID NO: 966658 - DNA, 25 bp, Mus musculus
tttcagacgcgttgcctggtcccct

SEQ ID NO: 966659 - DNA, 25 bp, Mus musculus
tttcagacgtccatccgggtgttag

SEQ ID NO: 966660 - DNA, 25 bp, Mus musculus
tttcagacgtccttccgggtgttag

SEQ ID NO: 966661 - DNA, 25 bp, Mus musculus
tttcagactccaatgaatcataggg

SEQ ID NO: 966662 - DNA, 25 bp, Mus musculus
tttcagactccattgaatcataggg

SEQ ID NO: 966663 - DNA, 25 bp, Mus musculus
tttcagactggtcccatggaactct

SEQ ID NO: 966664 - DNA, 25 bp, Mus musculus
tttcagactggtgccatggaactct

SEQ ID NO: 966665 - DNA, 25 bp, Mus musculus
tttcagagacacctaccagcttcct

SEQ ID NO: 966666 - DNA, 25 bp, Mus musculus
tttcagagacacgtaccagcttcct

SEQ ID NO: 966667 - DNA, 25 bp, Mus musculus
tttcagagaccaagtttttacactt

SEQ ID NO: 966668 - DNA, 25 bp, Mus musculus
tttcagagaccatgtttttacactt

SEQ ID NO: 966669 - DNA, 25 bp, Mus musculus
tttcagagagttatcttccagcctg

SEQ ID NO: 966670 - DNA, 25 bp, Mus musculus
tttcagagagttttcttccagcctg

SEQ ID NO: 966671 - DNA, 25 bp, Mus musculus
tttcagagcaccactttccaaagca

SEQ ID NO: 966672 - DNA, 25 bp, Mus musculus
tttcagagcacctctttccaaagca

SEQ ID NO: 966673 - DNA, 25 bp, Mus musculus
tttcagagcgacagcactatctcag

SEQ ID NO: 966674 - DNA, 25 bp, Mus musculus
tttcagagcgactgcactatctcag

SEQ ID NO: 966675 - DNA, 25 bp, Mus musculus
tttcagagctgtagcttgtcttttc

SEQ ID NO: 966676 - DNA, 25 bp, Mus musculus
tttcagagctgttgcttgtcttttc

SEQ ID NO: 966677 - DNA, 25 bp, Mus musculus
tttcagaggcccatggttcacttcc

SEQ ID NO: 966678 - DNA, 25 bp, Mus musculus
tttcagaggcccttggttcacttcc

SEQ ID NO: 966679 - DNA, 25 bp, Mus musculus
tttcagagtacacgcttctgggtct

SEQ ID NO: 966680 - DNA, 25 bp, Mus musculus
tttcagagtacaggcttctgggtct

SEQ ID NO: 966681 - DNA, 25 bp, Mus musculus
tttcagagtagtaagtgacatccct

SEQ ID NO: 966682 - DNA, 25 bp, Mus musculus
tttcagagtagttagtgacatccct

SEQ ID NO: 966683 - DNA, 25 bp, Mus musculus
tttcagagtcctcaaccaggcctta

SEQ ID NO: 966684 - DNA, 25 bp, Mus musculus
tttcagagtcctgaaccaggcctta

SEQ ID NO: 966685 - DNA, 25 bp, Mus musculus
tttcagagtctcatgcagcccacat

SEQ ID NO: 966686 - DNA, 25 bp, Mus musculus
tttcagagtctcttgcagcccacat

SEQ ID NO: 966687 - DNA, 25 bp, Mus musculus
tttcagagttttccaggccccatta

SEQ ID NO: 966688 - DNA, 25 bp, Mus musculus
tttcagagttttgcaggccccatta

SEQ ID NO: 966689 - DNA, 25 bp, Mus musculus
tttcagataaggaagtgtggtggtt

SEQ ID NO: 966690 - DNA, 25 bp, Mus musculus
tttcagataaggtagtgtggtggtt

SEQ ID NO: 966691 - DNA, 25 bp, Mus musculus
tttcagatacggagtgggtccctgt

SEQ ID NO: 966692 - DNA, 25 bp, Mus musculus
tttcagatacggtgtgggtccctgt

SEQ ID NO: 966693 - DNA, 25 bp, Mus musculus
tttcagatactgacattggttacct

SEQ ID NO: 966694 - DNA, 25 bp, Mus musculus
tttcagatactgtcattggttacct

SEQ ID NO: 966695 - DNA, 25 bp, Mus musculus
tttcagatacttctggcagcaaaca

SEQ ID NO: 966696 - DNA, 25 bp, Mus musculus
tttcagatacttgtggcagcaaaca

SEQ ID NO: 966697 - DNA, 25 bp, Mus musculus
tttcagatcaggagggtgtgcaacc

SEQ ID NO: 966698 - DNA, 25 bp, Mus musculus
tttcagatcaggtgggtgtgcaacc

SEQ ID NO: 966699 - DNA, 25 bp, Mus musculus
tttcagatcctcatggataccaaaa

SEQ ID NO: 966700 - DNA, 25 bp, Mus musculus
tttcagatcctcttggataccaaaa

SEQ ID NO: 966701 - DNA, 25 bp, Mus musculus
tttcagatctgccactgtgcaggtg

SEQ ID NO: 966702 - DNA, 25 bp, Mus musculus
tttcagatctgcgactgtgcaggtg

SEQ ID NO: 966703 - DNA, 25 bp, Mus musculus
tttcagatgcacagtcgcccagctt

SEQ ID NO: 966704 - DNA, 25 bp, Mus musculus
tttcagatgcactgtcgcccagctt

SEQ ID NO: 966705 - DNA, 25 bp, Mus musculus
tttcagatgctgactttatccattt

SEQ ID NO: 966706 - DNA, 25 bp, Mus musculus
tttcagatgctgtctttatccattt

SEQ ID NO: 966707 - DNA, 25 bp, Mus musculus
tttcagatggaaacttcggaagtat

SEQ ID NO: 966708 - DNA, 25 bp, Mus musculus
tttcagatggaatcttcggaagtat

SEQ ID NO: 966709 - DNA, 25 bp, Mus musculus
tttcagatgtaccagctttagcttg

SEQ ID NO: 966710 - DNA, 25 bp, Mus musculus
tttcagatgtacgagctttagcttg

SEQ ID NO: 966711 - DNA, 25 bp, Mus musculus
tttcagatgttcacgcagagctaga

SEQ ID NO: 966712 - DNA, 25 bp, Mus musculus
tttcagatgttctcgcagagctaga

SEQ ID NO: 966713 - DNA, 25 bp, Mus musculus
tttcagattggaaggtactacctct

SEQ ID NO: 966714 - DNA, 25 bp, Mus musculus
tttcagattggatggtactacctct

SEQ ID NO: 966715 - DNA, 25 bp, Mus musculus
tttcagcaaagaccaaagccactgc

SEQ ID NO: 966716 - DNA, 25 bp, Mus musculus
tttcagcaaagagcaaagccactgc

SEQ ID NO: 966717 - DNA, 25 bp, Mus musculus
tttcagcaagaccattggcaatctt

SEQ ID NO: 966718 - DNA, 25 bp, Mus musculus
tttcagcaagacgattggcaatctt

SEQ ID NO: 966719 - DNA, 25 bp, Mus musculus
tttcagcaagcccactccaaaatta

SEQ ID NO: 966720 - DNA, 25 bp, Mus musculus
tttcagcaagccgactccaaaatta

SEQ ID NO: 966721 - DNA, 25 bp, Mus musculus
tttcagcaaggtctaaagtcactta

SEQ ID NO: 966722 - DNA, 25 bp, Mus musculus
tttcagcaaggtgtaaagtcactta

SEQ ID NO: 966723 - DNA, 25 bp, Mus musculus
tttcagcacaagctcacaatacatg

SEQ ID NO: 966724 - DNA, 25 bp, Mus musculus
tttcagcacaaggtcacaatacatg

SEQ ID NO: 966725 - DNA, 25 bp, Mus musculus
tttcagcacagcctggagcttttaa

SEQ ID NO: 966726 - DNA, 25 bp, Mus musculus
tttcagcacagcgtggagcttttaa

SEQ ID NO: 966727 - DNA, 25 bp, Mus musculus
tttcagcaccaaatgctggccagtg

SEQ ID NO: 966728 - DNA, 25 bp, Mus musculus
tttcagcaccaattgctggccagtg

SEQ ID NO: 966729 - DNA, 25 bp, Mus musculus
tttcagcaccccagtactttgaaga

SEQ ID NO: 966730 - DNA, 25 bp, Mus musculus
tttcagcacccctgtactttgaaga

SEQ ID NO: 966731 - DNA, 25 bp, Mus musculus
tttcagcactcacattcaaggtcag

SEQ ID NO: 966732 - DNA, 25 bp, Mus musculus
tttcagcactcagattcaaggtcag

SEQ ID NO: 966733 - DNA, 25 bp, Mus musculus
tttcagcagacacgttttgccagca

SEQ ID NO: 966734 - DNA, 25 bp, Mus musculus
tttcagcagacaggttttgccagca

SEQ ID NO: 966735 - DNA, 25 bp, Mus musculus
tttcagcagaggcatgtgcacccaa

SEQ ID NO: 966736 - DNA, 25 bp, Mus musculus
tttcagcagagggatgtgcacccaa

SEQ ID NO: 966737 - DNA, 25 bp, Mus musculus
tttcagcagatcacccttcgtggta

SEQ ID NO: 966738 - DNA, 25 bp, Mus musculus
tttcagcagatctcccttcgtggta

SEQ ID NO: 966739 - DNA, 25 bp, Mus musculus
tttcagcagcttccttcacgtatta

SEQ ID NO: 966740 - DNA, 25 bp, Mus musculus
tttcagcagcttgcttcacgtatta

SEQ ID NO: 966741 - DNA, 25 bp, Mus musculus
tttcagcagtgtaggtgtggcacag

SEQ ID NO: 966742 - DNA, 25 bp, Mus musculus
tttcagcagtgttggtgtggcacag

SEQ ID NO: 966743 - DNA, 25 bp, Mus musculus
tttcagcatccaagtgtgggcccaa

SEQ ID NO: 966744 - DNA, 25 bp, Mus musculus
tttcagcatccatgtgtgggcccaa

SEQ ID NO: 966745 - DNA, 25 bp, Mus musculus
tttcagcatcccagaataattcgtg

SEQ ID NO: 966746 - DNA, 25 bp, Mus musculus
tttcagcatcccatcgagatacagg

SEQ ID NO: 966747 - DNA, 25 bp, Mus musculus
tttcagcatccctgaataattcgtg

SEQ ID NO: 966748 - DNA, 25 bp, Mus musculus
tttcagcatcccttcgagatacagg

SEQ ID NO: 966749 - DNA, 25 bp, Mus musculus
tttcagcatcttctggttttatgaa

SEQ ID NO: 966750 - DNA, 25 bp, Mus musculus
tttcagcatcttgtggttttatgaa

SEQ ID NO: 966751 - DNA, 25 bp, Mus musculus
tttcagcatgaaatacctcatcatt

SEQ ID NO: 966752 - DNA, 25 bp, Mus musculus
tttcagcatgaattacctcatcatt

SEQ ID NO: 966753 - DNA, 25 bp, Mus musculus
tttcagccaaacctcatgccttatt

SEQ ID NO: 966754 - DNA, 25 bp, Mus musculus
tttcagccaaacgtcatgccttatt

SEQ ID NO: 966755 - DNA, 25 bp, Mus musculus
tttcagccaatgacaaaacgtcaaa

SEQ ID NO: 966756 - DNA, 25 bp, Mus musculus
tttcagccaatgtcaaaacgtcaaa

SEQ ID NO: 966757 - DNA, 25 bp, Mus musculus
tttcagccactgctctgctttctat

SEQ ID NO: 966758 - DNA, 25 bp, Mus musculus
tttcagccactggtctgctttctat

SEQ ID NO: 966759 - DNA, 25 bp, Mus musculus
tttcagccagatatgaggcctcaca

SEQ ID NO: 966760 - DNA, 25 bp, Mus musculus
tttcagccagatttgaggcctcaca

SEQ ID NO: 966761 - DNA, 25 bp, Mus musculus
tttcagccatacaccactggtcaca

SEQ ID NO: 966762 - DNA, 25 bp, Mus musculus
tttcagccatactccactggtcaca

SEQ ID NO: 966763 - DNA, 25 bp, Mus musculus
tttcagcccaggaatctacagtggt

SEQ ID NO: 966764 - DNA, 25 bp, Mus musculus
tttcagcccaggaattttgttactg

SEQ ID NO: 966765 - DNA, 25 bp, Mus musculus
tttcagcccaggtatctacagtggt

SEQ ID NO: 966766 - DNA, 25 bp, Mus musculus
tttcagcccaggtattttgttactg

SEQ ID NO: 966767 - DNA, 25 bp, Mus musculus
tttcagccccataaaccctgagtgt

SEQ ID NO: 966768 - DNA, 25 bp, Mus musculus
tttcagccccattaaccctgagtgt

SEQ ID NO: 966769 - DNA, 25 bp, Mus musculus
tttcagccccgaatttggccagaaa

SEQ ID NO: 966770 - DNA, 25 bp, Mus musculus
tttcagccccgattttggccagaaa

SEQ ID NO: 966771 - DNA, 25 bp, Mus musculus
tttcagccctgtacgattctcagaa

SEQ ID NO: 966772 - DNA, 25 bp, Mus musculus
tttcagccctgttcgattctcagaa

SEQ ID NO: 966773 - DNA, 25 bp, Mus musculus
tttcagcccttacgtaagagcaagc

SEQ ID NO: 966774 - DNA, 25 bp, Mus musculus
tttcagcccttaggtaagagcaagc

SEQ ID NO: 966775 - DNA, 25 bp, Mus musculus
tttcagcctgagcagctggtggagt

SEQ ID NO: 966776 - DNA, 25 bp, Mus musculus
tttcagcctgaggagctggtggagt

SEQ ID NO: 966777 - DNA, 25 bp, Mus musculus
tttcagcctggtccccttcatagtg

SEQ ID NO: 966778 - DNA, 25 bp, Mus musculus
tttcagcctggtgcccttcatagtg

SEQ ID NO: 966779 - DNA, 25 bp, Mus musculus
tttcagcctgtaatctccatggtta

SEQ ID NO: 966780 - DNA, 25 bp, Mus musculus
tttcagcctgtattctccatggtta

SEQ ID NO: 966781 - DNA, 25 bp, Mus musculus
tttcagcgctttattcagaacgcag

SEQ ID NO: 966782 - DNA, 25 bp, Mus musculus
tttcagcgcttttttcagaacgcag

SEQ ID NO: 966783 - DNA, 25 bp, Mus musculus
tttcagctactgatctgatgccaag

SEQ ID NO: 966784 - DNA, 25 bp, Mus musculus
tttcagctactgttctgatgccaag

SEQ ID NO: 966785 - DNA, 25 bp, Mus musculus
tttcagctagcaaccattgcagtat

SEQ ID NO: 966786 - DNA, 25 bp, Mus musculus
tttcagctagcaacctgtactccga

SEQ ID NO: 966787 - DNA, 25 bp, Mus musculus
tttcagctagcatccattgcagtat

SEQ ID NO: 966788 - DNA, 25 bp, Mus musculus
tttcagctagcatcctgtactccga

SEQ ID NO: 966789 - DNA, 25 bp, Mus musculus
tttcagctagctcggccactcattc

SEQ ID NO: 966790 - DNA, 25 bp, Mus musculus
tttcagctagctgggccactcattc

SEQ ID NO: 966791 - DNA, 25 bp, Mus musculus
tttcagctaggcaccagtcagcaaa

SEQ ID NO: 966792 - DNA, 25 bp, Mus musculus
tttcagctaggctccagtcagcaaa

SEQ ID NO: 966793 - DNA, 25 bp, Mus musculus
tttcagctcccaccaaatagggaac

SEQ ID NO: 966794 - DNA, 25 bp, Mus musculus
tttcagctcccagcaaatagggaac

SEQ ID NO: 966795 - DNA, 25 bp, Mus musculus
tttcagctcctcatcggcgctcgat

SEQ ID NO: 966796 - DNA, 25 bp, Mus musculus
tttcagctcctcttcggcgctcgat

SEQ ID NO: 966797 - DNA, 25 bp, Mus musculus
tttcagctctggatcctctaaaagg

SEQ ID NO: 966798 - DNA, 25 bp, Mus musculus
tttcagctctggttcctctaaaagg

SEQ ID NO: 966799 - DNA, 25 bp, Mus musculus
tttcagctcttccaactttcagagt

SEQ ID NO: 966800 - DNA, 25 bp, Mus musculus
tttcagctcttccaaggtgcccctg

SEQ ID NO: 966801 - DNA, 25 bp, Mus musculus
tttcagctcttcctaatttactttt

SEQ ID NO: 966802 - DNA, 25 bp, Mus musculus
tttcagctcttcgaactttcagagt

SEQ ID NO: 966803 - DNA, 25 bp, Mus musculus
tttcagctcttcgaaggtgcccctg

SEQ ID NO: 966804 - DNA, 25 bp, Mus musculus
tttcagctcttcgtaatttactttt

SEQ ID NO: 966805 - DNA, 25 bp, Mus musculus
tttcagctcttgctgaatcccatga

SEQ ID NO: 966806 - DNA, 25 bp, Mus musculus
tttcagctcttggtgaatcccatga

SEQ ID NO: 966807 - DNA, 25 bp, Mus musculus
tttcagctggttcacggctttcctc

SEQ ID NO: 966808 - DNA, 25 bp, Mus musculus
tttcagctggttgacggctttcctc

SEQ ID NO: 966809 - DNA, 25 bp, Mus musculus
tttcagctgttcacaacgctgttgc

SEQ ID NO: 966810 - DNA, 25 bp, Mus musculus
tttcagctgttctcaacgctgttgc

SEQ ID NO: 966811 - DNA, 25 bp, Mus musculus
tttcagcttcccatcaaaactgcac

SEQ ID NO: 966812 - DNA, 25 bp, Mus musculus
tttcagcttcccttcaaaactgcac

SEQ ID NO: 966813 - DNA, 25 bp, Mus musculus
tttcagcttgccaccgtaccttgag

SEQ ID NO: 966814 - DNA, 25 bp, Mus musculus
tttcagcttgcctccgtaccttgag

SEQ ID NO: 966815 - DNA, 25 bp, Mus musculus
tttcagcttgctctgtaactcatgc

SEQ ID NO: 966816 - DNA, 25 bp, Mus musculus
tttcagcttgctgtgtaactcatgc

SEQ ID NO: 966817 - DNA, 25 bp, Mus musculus
tttcagcttttaatggaaggaagtg

SEQ ID NO: 966818 - DNA, 25 bp, Mus musculus
tttcagcttttattggaaggaagtg

SEQ ID NO: 966819 - DNA, 25 bp, Mus musculus
tttcaggaaattcagccagcttgtt

SEQ ID NO: 966820 - DNA, 25 bp, Mus musculus
tttcaggaaattgagccagcttgtt

SEQ ID NO: 966821 - DNA, 25 bp, Mus musculus
tttcaggaagcaatacggacccgaa

SEQ ID NO: 966822 - DNA, 25 bp, Mus musculus
tttcaggaagcattacggacccgaa

SEQ ID NO: 966823 - DNA, 25 bp, Mus musculus
tttcaggaagccataaccctttcag

SEQ ID NO: 966824 - DNA, 25 bp, Mus musculus
tttcaggaagccttaaccctttcag

SEQ ID NO: 966825 - DNA, 25 bp, Mus musculus
tttcaggaagctattaactgtgatg

SEQ ID NO: 966826 - DNA, 25 bp, Mus musculus
tttcaggaagcttttaactgtgatg

SEQ ID NO: 966827 - DNA, 25 bp, Mus musculus
tttcaggaagtactcggccgtgttt

SEQ ID NO: 966828 - DNA, 25 bp, Mus musculus
tttcaggaagtagtcggccgtgttt

SEQ ID NO: 966829 - DNA, 25 bp, Mus musculus
tttcaggaattcatcggcagaggac

SEQ ID NO: 966830 - DNA, 25 bp, Mus musculus
tttcaggaattcttcggcagaggac

SEQ ID NO: 966831 - DNA, 25 bp, Mus musculus
tttcaggacacccaggtctgtgaat

SEQ ID NO: 966832 - DNA, 25 bp, Mus musculus
tttcaggacaccccacacattgctt

SEQ ID NO: 966833 - DNA, 25 bp, Mus musculus
tttcaggacaccgaggtctgtgaat

SEQ ID NO: 966834 - DNA, 25 bp, Mus musculus
tttcaggacaccgcacacattgctt

SEQ ID NO: 966835 - DNA, 25 bp, Mus musculus
tttcaggacaggcacaacaatagct

SEQ ID NO: 966836 - DNA, 25 bp, Mus musculus
tttcaggacagggacaacaatagct

SEQ ID NO: 966837 - DNA, 25 bp, Mus musculus
tttcaggaccctagaagagagcttt

SEQ ID NO: 966838 - DNA, 25 bp, Mus musculus
tttcaggacccttgaagagagcttt

SEQ ID NO: 966839 - DNA, 25 bp, Mus musculus
tttcaggacctcagccagttgatga

SEQ ID NO: 966840 - DNA, 25 bp, Mus musculus
tttcaggacctctgccagttgatga

SEQ ID NO: 966841 - DNA, 25 bp, Mus musculus
tttcaggagaccacggcatcctcag

SEQ ID NO: 966842 - DNA, 25 bp, Mus musculus
tttcaggagacctcggcatcctcag

SEQ ID NO: 966843 - DNA, 25 bp, Mus musculus
tttcaggcagaaaatccctttgatt

SEQ ID NO: 966844 - DNA, 25 bp, Mus musculus
tttcaggcagaatatccctttgatt

SEQ ID NO: 966845 - DNA, 25 bp, Mus musculus
tttcaggcagggagatgagggcaca

SEQ ID NO: 966846 - DNA, 25 bp, Mus musculus
tttcaggcagggtgatgagggcaca

SEQ ID NO: 966847 - DNA, 25 bp, Mus musculus
tttcaggcgtatatttgtacagtga

SEQ ID NO: 966848 - DNA, 25 bp, Mus musculus
tttcaggcgtatttttgtacagtga

SEQ ID NO: 966849 - DNA, 25 bp, Mus musculus
tttcaggctagtaagaactacgcag

SEQ ID NO: 966850 - DNA, 25 bp, Mus musculus
tttcaggctagttagaactacgcag

SEQ ID NO: 966851 - DNA, 25 bp, Mus musculus
tttcaggctccacagctccgaaagg

SEQ ID NO: 966852 - DNA, 25 bp, Mus musculus
tttcaggctccagagctccgaaagg

SEQ ID NO: 966853 - DNA, 25 bp, Mus musculus
tttcaggctgccctagtcagcgttc

SEQ ID NO: 966854 - DNA, 25 bp, Mus musculus
tttcaggctgccgtagtcagcgttc

SEQ ID NO: 966855 - DNA, 25 bp, Mus musculus
tttcaggctggcatggtcttacata

SEQ ID NO: 966856 - DNA, 25 bp, Mus musculus
tttcaggctggcttggtcttacata

SEQ ID NO: 966857 - DNA, 25 bp, Mus musculus
tttcaggctggtccttcaactttcc

SEQ ID NO: 966858 - DNA, 25 bp, Mus musculus
tttcaggctggtgcttcaactttcc

SEQ ID NO: 966859 - DNA, 25 bp, Mus musculus
tttcaggcttgcagggcctctctgg

SEQ ID NO: 966860 - DNA, 25 bp, Mus musculus
tttcaggcttgctgggcctctctgg

SEQ ID NO: 966861 - DNA, 25 bp, Mus musculus
tttcagggaacacctaagaccattt

SEQ ID NO: 966862 - DNA, 25 bp, Mus musculus
tttcagggaacagctaagaccattt

SEQ ID NO: 966863 - DNA, 25 bp, Mus musculus
tttcagggaatccatccgctaagcc

SEQ ID NO: 966864 - DNA, 25 bp, Mus musculus
tttcagggaatcgatccgctaagcc

SEQ ID NO: 966865 - DNA, 25 bp, Mus musculus
tttcagggagagaccacctggacat

SEQ ID NO: 966866 - DNA, 25 bp, Mus musculus
tttcagggagagtccacctggacat

SEQ ID NO: 966867 - DNA, 25 bp, Mus musculus
tttcagggagcccacttggtgcctc

SEQ ID NO: 966868 - DNA, 25 bp, Mus musculus
tttcagggagccgacttggtgcctc

SEQ ID NO: 966869 - DNA, 25 bp, Mus musculus
tttcagggatgtacagatcggagac

SEQ ID NO: 966870 - DNA, 25 bp, Mus musculus
tttcagggatgttcagatcggagac

SEQ ID NO: 966871 - DNA, 25 bp, Mus musculus
tttcagggcactcccgccaacgtgt

SEQ ID NO: 966872 - DNA, 25 bp, Mus musculus
tttcagggcactgccgccaacgtgt

SEQ ID NO: 966873 - DNA, 25 bp, Mus musculus
tttcagggcagcagttcagaggcta

SEQ ID NO: 966874 - DNA, 25 bp, Mus musculus
tttcagggcagctgttcagaggcta

SEQ ID NO: 966875 - DNA, 25 bp, Mus musculus
tttcagggccctcaaatctagacga

SEQ ID NO: 966876 - DNA, 25 bp, Mus musculus
tttcagggccctgaaatctagacga

SEQ ID NO: 966877 - DNA, 25 bp, Mus musculus
tttcagggcctgatgcccaaggagg

SEQ ID NO: 966878 - DNA, 25 bp, Mus musculus
tttcagggcctgttgcccaaggagg

SEQ ID NO: 966879 - DNA, 25 bp, Mus musculus
tttcagggcttgaccgtgatgaccc

SEQ ID NO: 966880 - DNA, 25 bp, Mus musculus
tttcagggcttgtccgtgatgaccc

SEQ ID NO: 966881 - DNA, 25 bp, Mus musculus
tttcagggtagcagtgaaaccagat

SEQ ID NO: 966882 - DNA, 25 bp, Mus musculus
tttcagggtagctgtgaaaccagat

SEQ ID NO: 966883 - DNA, 25 bp, Mus musculus
tttcagggtcatctgccagttctac

SEQ ID NO: 966884 - DNA, 25 bp, Mus musculus
tttcagggtcatgtgccagttctac

SEQ ID NO: 966885 - DNA, 25 bp, Mus musculus
tttcagggtcccagacttatgtgcc

SEQ ID NO: 966886 - DNA, 25 bp, Mus musculus
tttcagggtcccataataacacgtt

SEQ ID NO: 966887 - DNA, 25 bp, Mus musculus
tttcagggtccctgacttatgtgcc

SEQ ID NO: 966888 - DNA, 25 bp, Mus musculus
tttcagggtcccttaataacacgtt

SEQ ID NO: 966889 - DNA, 25 bp, Mus musculus
tttcagggttctacaacagcagggt

SEQ ID NO: 966890 - DNA, 25 bp, Mus musculus
tttcagggttcttcaacagcagggt

SEQ ID NO: 966891 - DNA, 25 bp, Mus musculus
tttcagggttggcttctggagacct

SEQ ID NO: 966892 - DNA, 25 bp, Mus musculus
tttcagggttgggttctggagacct

SEQ ID NO: 966893 - DNA, 25 bp, Mus musculus
tttcagggtttcaggtttgcacctt

SEQ ID NO: 966894 - DNA, 25 bp, Mus musculus
tttcagggtttctggtttgcacctt

SEQ ID NO: 966895 - DNA, 25 bp, Mus musculus
tttcaggtagctcatcacccttgtc

SEQ ID NO: 966896 - DNA, 25 bp, Mus musculus
tttcaggtagctcttttcaagtgca

SEQ ID NO: 966897 - DNA, 25 bp, Mus musculus
tttcaggtagctgatcacccttgtc

SEQ ID NO: 966898 - DNA, 25 bp, Mus musculus
tttcaggtagctgttttcaagtgca

SEQ ID NO: 966899 - DNA, 25 bp, Mus musculus
tttcaggtcgcacttttcttggctg

SEQ ID NO: 966900 - DNA, 25 bp, Mus musculus
tttcaggtcgcagttttcttggctg

SEQ ID NO: 966901 - DNA, 25 bp, Mus musculus
tttcaggtgagaaccatggcacccc

SEQ ID NO: 966902 - DNA, 25 bp, Mus musculus
tttcaggtgagatccatggcacccc

SEQ ID NO: 966903 - DNA, 25 bp, Mus musculus
tttcaggtgcctatccgggtatgtc

SEQ ID NO: 966904 - DNA, 25 bp, Mus musculus
tttcaggtgcctttccgggtatgtc

SEQ ID NO: 966905 - DNA, 25 bp, Mus musculus
tttcaggtgctacggtcggcattca

SEQ ID NO: 966906 - DNA, 25 bp, Mus musculus
tttcaggtgctagggtcggcattca

SEQ ID NO: 966907 - DNA, 25 bp, Mus musculus
tttcaggtgctgaaggagcccagct

SEQ ID NO: 966908 - DNA, 25 bp, Mus musculus
tttcaggtgctgagattgtctccac

SEQ ID NO: 966909 - DNA, 25 bp, Mus musculus
tttcaggtgctgtaggagcccagct

SEQ ID NO: 966910 - DNA, 25 bp, Mus musculus
tttcaggtgctgtgattgtctccac

SEQ ID NO: 966911 - DNA, 25 bp, Mus musculus
tttcaggtgtgcatggttcttggca

SEQ ID NO: 966912 - DNA, 25 bp, Mus musculus
tttcaggtgtgcttggttcttggca

SEQ ID NO: 966913 - DNA, 25 bp, Mus musculus
tttcaggttcagctacagtgtctct

SEQ ID NO: 966914 - DNA, 25 bp, Mus musculus
tttcaggttcaggtacagtgtctct

SEQ ID NO: 966915 - DNA, 25 bp, Mus musculus
tttcaggttgtgctgctttcgataa

SEQ ID NO: 966916 - DNA, 25 bp, Mus musculus
tttcaggttgtggtgctttcgataa

SEQ ID NO: 966917 - DNA, 25 bp, Mus musculus
tttcaggtttgcatgctcagtttct

SEQ ID NO: 966918 - DNA, 25 bp, Mus musculus
tttcaggtttgcttgctcagtttct

SEQ ID NO: 966919 - DNA, 25 bp, Mus musculus
tttcaggtttggcttccaagggctt

SEQ ID NO: 966920 - DNA, 25 bp, Mus musculus
tttcaggtttgggttccaagggctt

SEQ ID NO: 966921 - DNA, 25 bp, Mus musculus
tttcaggttttacgatggtcacaat

SEQ ID NO: 966922 - DNA, 25 bp, Mus musculus
tttcaggttttaggatggtcacaat

SEQ ID NO: 966923 - DNA, 25 bp, Mus musculus
tttcagtaccacagccctagtcaag

SEQ ID NO: 966924 - DNA, 25 bp, Mus musculus
tttcagtaccaccaaaaagaggcag

SEQ ID NO: 966925 - DNA, 25 bp, Mus musculus
tttcagtaccaccacacattaatta

SEQ ID NO: 966926 - DNA, 25 bp, Mus musculus
tttcagtaccacgaaaaagaggcag

SEQ ID NO: 966927 - DNA, 25 bp, Mus musculus
tttcagtaccacgacacattaatta

SEQ ID NO: 966928 - DNA, 25 bp, Mus musculus
tttcagtaccactgccctagtcaag

SEQ ID NO: 966929 - DNA, 25 bp, Mus musculus
tttcagtagaagaggcatagtgcac

SEQ ID NO: 966930 - DNA, 25 bp, Mus musculus
tttcagtagaagtggcatagtgcac

SEQ ID NO: 966931 - DNA, 25 bp, Mus musculus
tttcagtagagaccggtcacttcac

SEQ ID NO: 966932 - DNA, 25 bp, Mus musculus
tttcagtagagagcggtcacttcac

SEQ ID NO: 966933 - DNA, 25 bp, Mus musculus
tttcagtagcatctggccgtccagg

SEQ ID NO: 966934 - DNA, 25 bp, Mus musculus
tttcagtagcatgtggccgtccagg

SEQ ID NO: 966935 - DNA, 25 bp, Mus musculus
tttcagtagccgatctcaccctgtg

SEQ ID NO: 966936 - DNA, 25 bp, Mus musculus
tttcagtagccgttctcaccctgtg

SEQ ID NO: 966937 - DNA, 25 bp, Mus musculus
tttcagtagcctagcctgggtgtcc

SEQ ID NO: 966938 - DNA, 25 bp, Mus musculus
tttcagtagccttgcctgggtgtcc

SEQ ID NO: 966939 - DNA, 25 bp, Mus musculus
tttcagtaggaacccctgctagcct

SEQ ID NO: 966940 - DNA, 25 bp, Mus musculus
tttcagtaggaagccctgctagcct

SEQ ID NO: 966941 - DNA, 25 bp, Mus musculus
tttcagtagggcacgtgtaacctgc

SEQ ID NO: 966942 - DNA, 25 bp, Mus musculus
tttcagtagggctcgtgtaacctgc

SEQ ID NO: 966943 - DNA, 25 bp, Mus musculus
tttcagtatcctaggacccatcttt

SEQ ID NO: 966944 - DNA, 25 bp, Mus musculus
tttcagtatccttggacccatcttt

SEQ ID NO: 966945 - DNA, 25 bp, Mus musculus
tttcagtatcttacggagaccagct

SEQ ID NO: 966946 - DNA, 25 bp, Mus musculus
tttcagtatctttcggagaccagct

SEQ ID NO: 966947 - DNA, 25 bp, Mus musculus
tttcagtatgtacatccatgcctgt

SEQ ID NO: 966948 - DNA, 25 bp, Mus musculus
tttcagtatgtagatccatgcctgt

SEQ ID NO: 966949 - DNA, 25 bp, Mus musculus
tttcagtattaaagggcaccggttg

SEQ ID NO: 966950 - DNA, 25 bp, Mus musculus
tttcagtattaatgggcaccggttg

SEQ ID NO: 966951 - DNA, 25 bp, Mus musculus
tttcagtattttaccagtacctgga

SEQ ID NO: 966952 - DNA, 25 bp, Mus musculus
tttcagtatttttccagtacctgga

SEQ ID NO: 966953 - DNA, 25 bp, Mus musculus
tttcagtcagggacatgagcatgcg

SEQ ID NO: 966954 - DNA, 25 bp, Mus musculus
tttcagtcagggatattctctcctt

SEQ ID NO: 966955 - DNA, 25 bp, Mus musculus
tttcagtcagggtcatgagcatgcg

SEQ ID NO: 966956 - DNA, 25 bp, Mus musculus
tttcagtcagggttattctctcctt

SEQ ID NO: 966957 - DNA, 25 bp, Mus musculus
tttcagtccatgacgggaggctcaa

SEQ ID NO: 966958 - DNA, 25 bp, Mus musculus
tttcagtccatgtcgggaggctcaa

SEQ ID NO: 966959 - DNA, 25 bp, Mus musculus
tttcagtcctcaagagttaaggcat

SEQ ID NO: 966960 - DNA, 25 bp, Mus musculus
tttcagtcctcaagggctaggaaga

SEQ ID NO: 966961 - DNA, 25 bp, Mus musculus
tttcagtcctcatgagttaaggcat

SEQ ID NO: 966962 - DNA, 25 bp, Mus musculus
tttcagtcctcatgggctaggaaga

SEQ ID NO: 966963 - DNA, 25 bp, Mus musculus
tttcagtcgctgagagagtggccac

SEQ ID NO: 966964 - DNA, 25 bp, Mus musculus
tttcagtcgctgtgagagtggccac

SEQ ID NO: 966965 - DNA, 25 bp, Mus musculus
tttcagtctcctactgtgtctcgaa

SEQ ID NO: 966966 - DNA, 25 bp, Mus musculus
tttcagtctccttctgtgtctcgaa

SEQ ID NO: 966967 - DNA, 25 bp, Mus musculus
tttcagtctgttccacagtgctgca

SEQ ID NO: 966968 - DNA, 25 bp, Mus musculus
tttcagtctgttgcacagtgctgca

SEQ ID NO: 966969 - DNA, 25 bp, Mus musculus
tttcagtgacgccattgacttcctt

SEQ ID NO: 966970 - DNA, 25 bp, Mus musculus
tttcagtgacgcgattgacttcctt

SEQ ID NO: 966971 - DNA, 25 bp, Mus musculus
tttcagtgattccaaagagcattct

SEQ ID NO: 966972 - DNA, 25 bp, Mus musculus
tttcagtgattcgaaagagcattct

SEQ ID NO: 966973 - DNA, 25 bp, Mus musculus
tttcagtgccacatgtgcgaccggg

SEQ ID NO: 966974 - DNA, 25 bp, Mus musculus
tttcagtgccaccagcacgtctggc

SEQ ID NO: 966975 - DNA, 25 bp, Mus musculus
tttcagtgccacgagcacgtctggc

SEQ ID NO: 966976 - DNA, 25 bp, Mus musculus
tttcagtgccacttgtgcgaccggg

SEQ ID NO: 966977 - DNA, 25 bp, Mus musculus
tttcagtgctttatgagtttctcat

SEQ ID NO: 966978 - DNA, 25 bp, Mus musculus
tttcagtgctttttgagtttctcat

SEQ ID NO: 966979 - DNA, 25 bp, Mus musculus
tttcagtggcttcactcatgagctt

SEQ ID NO: 966980 - DNA, 25 bp, Mus musculus
tttcagtggcttgactcatgagctt

SEQ ID NO: 966981 - DNA, 25 bp, Mus musculus
tttcagtgtgtcacttgtctgtcac

SEQ ID NO: 966982 - DNA, 25 bp, Mus musculus
tttcagtgtgtctcttgtctgtcac

SEQ ID NO: 966983 - DNA, 25 bp, Mus musculus
tttcagtgttacactgtcagttgac

SEQ ID NO: 966984 - DNA, 25 bp, Mus musculus
tttcagtgttactctgtcagttgac

SEQ ID NO: 966985 - DNA, 25 bp, Mus musculus
tttcagtgttctatgtatgtctgtg

SEQ ID NO: 966986 - DNA, 25 bp, Mus musculus
tttcagtgttctttgtatgtctgtg

SEQ ID NO: 966987 - DNA, 25 bp, Mus musculus
tttcagttaataactctgcggtaaa

SEQ ID NO: 966988 - DNA, 25 bp, Mus musculus
tttcagttaatatctctgcggtaaa

SEQ ID NO: 966989 - DNA, 25 bp, Mus musculus
tttcagttaggccttcccagttgtc

SEQ ID NO: 966990 - DNA, 25 bp, Mus musculus
tttcagttaggcgttcccagttgtc

SEQ ID NO: 966991 - DNA, 25 bp, Mus musculus
tttcagttagttaaaccatcccaat

SEQ ID NO: 966992 - DNA, 25 bp, Mus musculus
tttcagttagtttaaccatcccaat

SEQ ID NO: 966993 - DNA, 25 bp, Mus musculus
tttcagttatggattctctgggtag

SEQ ID NO: 966994 - DNA, 25 bp, Mus musculus
tttcagttatggtttctctgggtag

SEQ ID NO: 966995 - DNA, 25 bp, Mus musculus
tttcagttcagtcccagttcttaaa

SEQ ID NO: 966996 - DNA, 25 bp, Mus musculus
tttcagttcagtgccagttcttaaa

SEQ ID NO: 966997 - DNA, 25 bp, Mus musculus
tttcagttcatacaggtctcacaaa

SEQ ID NO: 966998 - DNA, 25 bp, Mus musculus
tttcagttcatagaggtctcacaaa

SEQ ID NO: 966999 - DNA, 25 bp, Mus musculus
tttcagttccagaagctccagcaag

SEQ ID NO: 967000 - DNA, 25 bp, Mus musculus
tttcagttccagtagctccagcaag

SEQ ID NO: 967001 - DNA, 25 bp, Mus musculus
tttcagttcttaactctgtcagcag

SEQ ID NO: 967002 - DNA, 25 bp, Mus musculus
tttcagttcttatctctgtcagcag

SEQ ID NO: 967003 - DNA, 25 bp, Mus musculus
tttcagttgctgaatttccagggag

SEQ ID NO: 967004 - DNA, 25 bp, Mus musculus
tttcagttgctgtatttccagggag

SEQ ID NO: 967005 - DNA, 25 bp, Mus musculus
tttcagttggccactcaaggaagag

SEQ ID NO: 967006 - DNA, 25 bp, Mus musculus
tttcagttggcctctcaaggaagag

SEQ ID NO: 967007 - DNA, 25 bp, Mus musculus
tttcagttgtttcgcctggaacttc

SEQ ID NO: 967008 - DNA, 25 bp, Mus musculus
tttcagttgtttggcctggaacttc

SEQ ID NO: 967009 - DNA, 25 bp, Mus musculus
tttcataacctgattcactgcctga

SEQ ID NO: 967010 - DNA, 25 bp, Mus musculus
tttcataacctgtttcactgcctga

SEQ ID NO: 967011 - DNA, 25 bp, Mus musculus
tttcataaccttccttgtaacccag

SEQ ID NO: 967012 - DNA, 25 bp, Mus musculus
tttcataaccttgcttgtaacccag

SEQ ID NO: 967013 - DNA, 25 bp, Mus musculus
tttcataacgtgaaattgcttgttt

SEQ ID NO: 967014 - DNA, 25 bp, Mus musculus
tttcataacgtgtaattgcttgttt

SEQ ID NO: 967015 - DNA, 25 bp, Mus musculus
tttcataatcttctgtcgtcacctg

SEQ ID NO: 967016 - DNA, 25 bp, Mus musculus
tttcataatcttgtgtcgtcacctg

SEQ ID NO: 967017 - DNA, 25 bp, Mus musculus
tttcataatgacaccacctagtgcc

SEQ ID NO: 967018 - DNA, 25 bp, Mus musculus
tttcataatgactccacctagtgcc

SEQ ID NO: 967019 - DNA, 25 bp, Mus musculus
tttcataattcaaactcagtcgctt

SEQ ID NO: 967020 - DNA, 25 bp, Mus musculus
tttcataattcatactcagtcgctt

SEQ ID NO: 967021 - DNA, 25 bp, Mus musculus
tttcatacaaacatccttcccggtg

SEQ ID NO: 967022 - DNA, 25 bp, Mus musculus
tttcatacaaacttccttcccggtg

SEQ ID NO: 967023 - DNA, 25 bp, Mus musculus
tttcataccataaagtctggccatg

SEQ ID NO: 967024 - DNA, 25 bp, Mus musculus
tttcataccatatagtctggccatg

SEQ ID NO: 967025 - DNA, 25 bp, Mus musculus
tttcataccattctttttccactaa

SEQ ID NO: 967026 - DNA, 25 bp, Mus musculus
tttcataccattgtttttccactaa

SEQ ID NO: 967027 - DNA, 25 bp, Mus musculus
tttcataccctgagctattcttata

SEQ ID NO: 967028 - DNA, 25 bp, Mus musculus
tttcataccctgtgctattcttata

SEQ ID NO: 967029 - DNA, 25 bp, Mus musculus
tttcatactctcatttatttcctgt

SEQ ID NO: 967030 - DNA, 25 bp, Mus musculus
tttcatactctcttttatttcctgt

SEQ ID NO: 967031 - DNA, 25 bp, Mus musculus
tttcatactgacaaagtagcctgga

SEQ ID NO: 967032 - DNA, 25 bp, Mus musculus
tttcatactgactaagtagcctgga

SEQ ID NO: 967033 - DNA, 25 bp, Mus musculus
tttcatactgttaccttctttcttt

SEQ ID NO: 967034 - DNA, 25 bp, Mus musculus
tttcatactgtttccttctttcttt

SEQ ID NO: 967035 - DNA, 25 bp, Mus musculus
tttcatagagttccttgtacagaat

SEQ ID NO: 967036 - DNA, 25 bp, Mus musculus
tttcatagagttgcttgtacagaat

SEQ ID NO: 967037 - DNA, 25 bp, Mus musculus
tttcatagattcattcaacctgagg

SEQ ID NO: 967038 - DNA, 25 bp, Mus musculus
tttcatagattctttcaacctgagg

SEQ ID NO: 967039 - DNA, 25 bp, Mus musculus
tttcatagcaataaagaactccaaa

SEQ ID NO: 967040 - DNA, 25 bp, Mus musculus
tttcatagcaattaagaactccaaa

SEQ ID NO: 967041 - DNA, 25 bp, Mus musculus
tttcatagccctcgatccgttggaa

SEQ ID NO: 967042 - DNA, 25 bp, Mus musculus
tttcatagccctggatccgttggaa

SEQ ID NO: 967043 - DNA, 25 bp, Mus musculus
tttcataggcggcaaggcattttct

SEQ ID NO: 967044 - DNA, 25 bp, Mus musculus
tttcataggcgggaaggcattttct

SEQ ID NO: 967045 - DNA, 25 bp, Mus musculus
tttcataggctaatccagtttgtat

SEQ ID NO: 967046 - DNA, 25 bp, Mus musculus
tttcataggctattccagtttgtat

SEQ ID NO: 967047 - DNA, 25 bp, Mus musculus
tttcatagttagatccttcacgtct

SEQ ID NO: 967048 - DNA, 25 bp, Mus musculus
tttcatagttagttccttcacgtct

SEQ ID NO: 967049 - DNA, 25 bp, Mus musculus
tttcatatacctccaaaggcaccta

SEQ ID NO: 967050 - DNA, 25 bp, Mus musculus
tttcatatacctgcaaaggcaccta

SEQ ID NO: 967051 - DNA, 25 bp, Mus musculus
tttcatatcccactctgcattatca

SEQ ID NO: 967052 - DNA, 25 bp, Mus musculus
tttcatatcccagtctgcattatca

SEQ ID NO: 967053 - DNA, 25 bp, Mus musculus
tttcatatgcaactgtctttcctgg

SEQ ID NO: 967054 - DNA, 25 bp, Mus musculus
tttcatatgcaagtgtctttcctgg

SEQ ID NO: 967055 - DNA, 25 bp, Mus musculus
tttcatatgctaacccaaaaaggtc

SEQ ID NO: 967056 - DNA, 25 bp, Mus musculus
tttcatatgctatcccaaaaaggtc

SEQ ID NO: 967057 - DNA, 25 bp, Mus musculus
tttcatatgcttattgaccatttga

SEQ ID NO: 967058 - DNA, 25 bp, Mus musculus
tttcatatgctttttgaccatttga

SEQ ID NO: 967059 - DNA, 25 bp, Mus musculus
tttcatatggctacacctgtgttat

SEQ ID NO: 967060 - DNA, 25 bp, Mus musculus
tttcatatggcttcacctgtgttat

SEQ ID NO: 967061 - DNA, 25 bp, Mus musculus
tttcatatttctctatcatgctaga

SEQ ID NO: 967062 - DNA, 25 bp, Mus musculus
tttcatatttctgtatcatgctaga

SEQ ID NO: 967063 - DNA, 25 bp, Mus musculus
tttcatcaaactctttgcccagagg

SEQ ID NO: 967064 - DNA, 25 bp, Mus musculus
tttcatcaaactgtttgcccagagg

SEQ ID NO: 967065 - DNA, 25 bp, Mus musculus
tttcatcaaattaggttggctctgt

SEQ ID NO: 967066 - DNA, 25 bp, Mus musculus
tttcatcaaatttggttggctctgt

SEQ ID NO: 967067 - DNA, 25 bp, Mus musculus
tttcatcaacgtcaaagagccacat

SEQ ID NO: 967068 - DNA, 25 bp, Mus musculus
tttcatcaacgtgaaagagccacat

SEQ ID NO: 967069 - DNA, 25 bp, Mus musculus
tttcatcaagcaatggtcctaccag

SEQ ID NO: 967070 - DNA, 25 bp, Mus musculus
tttcatcaagcattggtcctaccag

SEQ ID NO: 967071 - DNA, 25 bp, Mus musculus
tttcatcacagaagccaggtggccc

SEQ ID NO: 967072 - DNA, 25 bp, Mus musculus
tttcatcacagatgccaggtggccc

SEQ ID NO: 967073 - DNA, 25 bp, Mus musculus
tttcatcacaggacgctttagcaag

SEQ ID NO: 967074 - DNA, 25 bp, Mus musculus
tttcatcacaggtcgctttagcaag

SEQ ID NO: 967075 - DNA, 25 bp, Mus musculus
tttcatcacagtcacaaaggagaat

SEQ ID NO: 967076 - DNA, 25 bp, Mus musculus
tttcatcacagtgacaaaggagaat

SEQ ID NO: 967077 - DNA, 25 bp, Mus musculus
tttcatcagagaaaacccagatact

SEQ ID NO: 967078 - DNA, 25 bp, Mus musculus
tttcatcagagataacccagatact

SEQ ID NO: 967079 - DNA, 25 bp, Mus musculus
tttcatcagtctccaatactaagtg

SEQ ID NO: 967080 - DNA, 25 bp, Mus musculus
tttcatcagtctgcaatactaagtg

SEQ ID NO: 967081 - DNA, 25 bp, Mus musculus
tttcatcagtgaccgtaaacattgg

SEQ ID NO: 967082 - DNA, 25 bp, Mus musculus
tttcatcagtgagcgtaaacattgg

SEQ ID NO: 967083 - DNA, 25 bp, Mus musculus
tttcatcatgaccatgcccaaactg

SEQ ID NO: 967084 - DNA, 25 bp, Mus musculus
tttcatcatgacgatgcccaaactg

SEQ ID NO: 967085 - DNA, 25 bp, Mus musculus
tttcatcatgtcacaaaaaccttta

SEQ ID NO: 967086 - DNA, 25 bp, Mus musculus
tttcatcatgtctcaaaaaccttta

SEQ ID NO: 967087 - DNA, 25 bp, Mus musculus
tttcatcatgtgctcaggacaatgt

SEQ ID NO: 967088 - DNA, 25 bp, Mus musculus
tttcatcatgtggtcaggacaatgt

SEQ ID NO: 967089 - DNA, 25 bp, Mus musculus
tttcatcattggcactcaacccaaa

SEQ ID NO: 967090 - DNA, 25 bp, Mus musculus
tttcatcattgggactcaacccaaa

SEQ ID NO: 967091 - DNA, 25 bp, Mus musculus
tttcatccacacagtgcccaggaca

SEQ ID NO: 967092 - DNA, 25 bp, Mus musculus
tttcatccacactgtgcccaggaca

SEQ ID NO: 967093 - DNA, 25 bp, Mus musculus
tttcatccagaacctgttccggcct

SEQ ID NO: 967094 - DNA, 25 bp, Mus musculus
tttcatccagaagctgttccggcct

SEQ ID NO: 967095 - DNA, 25 bp, Mus musculus
tttcatccatgtatgttgcatcttt

SEQ ID NO: 967096 - DNA, 25 bp, Mus musculus
tttcatccatgtttgttgcatcttt

SEQ ID NO: 967097 - DNA, 25 bp, Mus musculus
tttcatcccaccatctacaaattag

SEQ ID NO: 967098 - DNA, 25 bp, Mus musculus
tttcatcccaccttctacaaattag

SEQ ID NO: 967099 - DNA, 25 bp, Mus musculus
tttcatcccagcaaatggcttctta

SEQ ID NO: 967100 - DNA, 25 bp, Mus musculus
tttcatcccagcctactgtaggagt

SEQ ID NO: 967101 - DNA, 25 bp, Mus musculus
tttcatcccagcgtactgtaggagt

SEQ ID NO: 967102 - DNA, 25 bp, Mus musculus
tttcatcccagctaatggcttctta

SEQ ID NO: 967103 - DNA, 25 bp, Mus musculus
tttcatcccattactgtgaactccc

SEQ ID NO: 967104 - DNA, 25 bp, Mus musculus
tttcatcccatttctgtgaactccc

SEQ ID NO: 967105 - DNA, 25 bp, Mus musculus
tttcatccccaacccaacggtgtgt

SEQ ID NO: 967106 - DNA, 25 bp, Mus musculus
tttcatccccaagccaacggtgtgt

SEQ ID NO: 967107 - DNA, 25 bp, Mus musculus
tttcatccccacatgttcttatcag

SEQ ID NO: 967108 - DNA, 25 bp, Mus musculus
tttcatccccacttgttcttatcag

SEQ ID NO: 967109 - DNA, 25 bp, Mus musculus
tttcatccccatatggcagggagaa

SEQ ID NO: 967110 - DNA, 25 bp, Mus musculus
tttcatccccatttggcagggagaa

SEQ ID NO: 967111 - DNA, 25 bp, Mus musculus
tttcatccctctattgactaaaatg

SEQ ID NO: 967112 - DNA, 25 bp, Mus musculus
tttcatccctcttttgactaaaatg

SEQ ID NO: 967113 - DNA, 25 bp, Mus musculus
tttcatccgcagagccattttgctg

SEQ ID NO: 967114 - DNA, 25 bp, Mus musculus
tttcatccgcagtgccattttgctg

SEQ ID NO: 967115 - DNA, 25 bp, Mus musculus
tttcatccgctccagatacaacctg

SEQ ID NO: 967116 - DNA, 25 bp, Mus musculus
tttcatccgctcgagatacaacctg

SEQ ID NO: 967117 - DNA, 25 bp, Mus musculus
tttcatcctataatggtgttgtatc

SEQ ID NO: 967118 - DNA, 25 bp, Mus musculus
tttcatcctatattggtgttgtatc

SEQ ID NO: 967119 - DNA, 25 bp, Mus musculus
tttcatcctatgattgtctgtatcc

SEQ ID NO: 967120 - DNA, 25 bp, Mus musculus
tttcatcctatgtttgtctgtatcc

SEQ ID NO: 967121 - DNA, 25 bp, Mus musculus
tttcatcctcctaagctgttacata

SEQ ID NO: 967122 - DNA, 25 bp, Mus musculus
tttcatcctccttagctgttacata

SEQ ID NO: 967123 - DNA, 25 bp, Mus musculus
tttcatccttcaccaacaaagcatc

SEQ ID NO: 967124 - DNA, 25 bp, Mus musculus
tttcatccttcagcaacaaagcatc

SEQ ID NO: 967125 - DNA, 25 bp, Mus musculus
tttcatccttccaagtgcttcaact

SEQ ID NO: 967126 - DNA, 25 bp, Mus musculus
tttcatccttcctagtgcttcaact

SEQ ID NO: 967127 - DNA, 25 bp, Mus musculus
tttcatccttgtaattcagactggg

SEQ ID NO: 967128 - DNA, 25 bp, Mus musculus
tttcatccttgttattcagactggg

SEQ ID NO: 967129 - DNA, 25 bp, Mus musculus
tttcatcctttgaccatggtttccc

SEQ ID NO: 967130 - DNA, 25 bp, Mus musculus
tttcatcctttgtccatggtttccc

SEQ ID NO: 967131 - DNA, 25 bp, Mus musculus
tttcatctaaggaccctccctttgt

SEQ ID NO: 967132 - DNA, 25 bp, Mus musculus
tttcatctaaggtccctccctttgt

SEQ ID NO: 967133 - DNA, 25 bp, Mus musculus
tttcatctatttcaccatgtgacgg

SEQ ID NO: 967134 - DNA, 25 bp, Mus musculus
tttcatctatttgaccatgtgacgg

SEQ ID NO: 967135 - DNA, 25 bp, Mus musculus
tttcatctcatcctcaagtcaaaat

SEQ ID NO: 967136 - DNA, 25 bp, Mus musculus
tttcatctcatcgtcaagtcaaaat

SEQ ID NO: 967137 - DNA, 25 bp, Mus musculus
tttcatctcctcattgggtaaatat

SEQ ID NO: 967138 - DNA, 25 bp, Mus musculus
tttcatctcctctttgggtaaatat

SEQ ID NO: 967139 - DNA, 25 bp, Mus musculus
tttcatctggctattcgtcatttct

SEQ ID NO: 967140 - DNA, 25 bp, Mus musculus
tttcatctggcttttcgtcatttct

SEQ ID NO: 967141 - DNA, 25 bp, Mus musculus
tttcatctgtctacccatgacatta

SEQ ID NO: 967142 - DNA, 25 bp, Mus musculus
tttcatctgtcttcccatgacatta

SEQ ID NO: 967143 - DNA, 25 bp, Mus musculus
tttcatctgtgactgcttgcggact

SEQ ID NO: 967144 - DNA, 25 bp, Mus musculus
tttcatctgtgagtgcttgcggact

SEQ ID NO: 967145 - DNA, 25 bp, Mus musculus
tttcatctgtgcctaagctagtact

SEQ ID NO: 967146 - DNA, 25 bp, Mus musculus
tttcatctgtgcgtaagctagtact

SEQ ID NO: 967147 - DNA, 25 bp, Mus musculus
tttcatctgtggagcctagttctgc

SEQ ID NO: 967148 - DNA, 25 bp, Mus musculus
tttcatctgtggtgcctagttctgc

SEQ ID NO: 967149 - DNA, 25 bp, Mus musculus
tttcatcttcagacctgctaacagg

SEQ ID NO: 967150 - DNA, 25 bp, Mus musculus
tttcatcttcagtcctgctaacagg

SEQ ID NO: 967151 - DNA, 25 bp, Mus musculus
tttcatcttccaagccaaggccaaa

SEQ ID NO: 967152 - DNA, 25 bp, Mus musculus
tttcatcttccatgccaaggccaaa

SEQ ID NO: 967153 - DNA, 25 bp, Mus musculus
tttcatcttcccaattctcctcatc

SEQ ID NO: 967154 - DNA, 25 bp, Mus musculus
tttcatcttccctattctcctcatc

SEQ ID NO: 967155 - DNA, 25 bp, Mus musculus
tttcatcttgagcatgcctgtccac

SEQ ID NO: 967156 - DNA, 25 bp, Mus musculus
tttcatcttgaggatgcctgtccac

SEQ ID NO: 967157 - DNA, 25 bp, Mus musculus
tttcatcttggcagctgtggacact

SEQ ID NO: 967158 - DNA, 25 bp, Mus musculus
tttcatcttggctgctgtggacact

SEQ ID NO: 967159 - DNA, 25 bp, Mus musculus
tttcatcttgtaagctttcaactag

SEQ ID NO: 967160 - DNA, 25 bp, Mus musculus
tttcatcttgtatgctttcaactag

SEQ ID NO: 967161 - DNA, 25 bp, Mus musculus
tttcatctttctctcgaacagagtg

SEQ ID NO: 967162 - DNA, 25 bp, Mus musculus
tttcatctttctgtcgaacagagtg

SEQ ID NO: 967163 - DNA, 25 bp, Mus musculus
tttcatgaaaagctcaaatcattat

SEQ ID NO: 967164 - DNA, 25 bp, Mus musculus
tttcatgaaaaggtcaaatcattat

SEQ ID NO: 967165 - DNA, 25 bp, Mus musculus
tttcatgaatatccgcctggccaat

SEQ ID NO: 967166 - DNA, 25 bp, Mus musculus
tttcatgaatatgcgcctggccaat

SEQ ID NO: 967167 - DNA, 25 bp, Mus musculus
tttcatgaccttaggcaggacttct

SEQ ID NO: 967168 - DNA, 25 bp, Mus musculus
tttcatgacctttggcaggacttct

SEQ ID NO: 967169 - DNA, 25 bp, Mus musculus
tttcatgagaccactggtttctttc

SEQ ID NO: 967170 - DNA, 25 bp, Mus musculus
tttcatgagacctctggtttctttc

SEQ ID NO: 967171 - DNA, 25 bp, Mus musculus
tttcatgagcagaagttgcccaaga

SEQ ID NO: 967172 - DNA, 25 bp, Mus musculus
tttcatgagcagtagttgcccaaga

SEQ ID NO: 967173 - DNA, 25 bp, Mus musculus
tttcatgagggtagcctaaggccac

SEQ ID NO: 967174 - DNA, 25 bp, Mus musculus
tttcatgagggttgcctaaggccac

SEQ ID NO: 967175 - DNA, 25 bp, Mus musculus
tttcatgagtagcacaggcacaggt

SEQ ID NO: 967176 - DNA, 25 bp, Mus musculus
tttcatgagtaggacaggcacaggt

SEQ ID NO: 967177 - DNA, 25 bp, Mus musculus
tttcatgcacccacataaagtaccc

SEQ ID NO: 967178 - DNA, 25 bp, Mus musculus
tttcatgcaccctcataaagtaccc

SEQ ID NO: 967179 - DNA, 25 bp, Mus musculus
tttcatgcagatagacagtcagact

SEQ ID NO: 967180 - DNA, 25 bp, Mus musculus
tttcatgcagattgacagtcagact

SEQ ID NO: 967181 - DNA, 25 bp, Mus musculus
tttcatgcccatctaccaatgaatg

SEQ ID NO: 967182 - DNA, 25 bp, Mus musculus
tttcatgcccatgtaccaatgaatg

SEQ ID NO: 967183 - DNA, 25 bp, Mus musculus
tttcatgcccctctttaggagctat

SEQ ID NO: 967184 - DNA, 25 bp, Mus musculus
tttcatgcccctgtttaggagctat

SEQ ID NO: 967185 - DNA, 25 bp, Mus musculus
tttcatgcctccaggatacgaagag

SEQ ID NO: 967186 - DNA, 25 bp, Mus musculus
tttcatgcctcctggatacgaagag

SEQ ID NO: 967187 - DNA, 25 bp, Mus musculus
tttcatgcctggagaaagtcatcac

SEQ ID NO: 967188 - DNA, 25 bp, Mus musculus
tttcatgcctggtgaaagtcatcac

SEQ ID NO: 967189 - DNA, 25 bp, Mus musculus
tttcatgcctgtagaccctagttat

SEQ ID NO: 967190 - DNA, 25 bp, Mus musculus
tttcatgcctgttgaccctagttat

SEQ ID NO: 967191 - DNA, 25 bp, Mus musculus
tttcatgcgcggcaggcctaggaca

SEQ ID NO: 967192 - DNA, 25 bp, Mus musculus
tttcatgcgcgggaggcctaggaca

SEQ ID NO: 967193 - DNA, 25 bp, Mus musculus
tttcatgctacaactttggcactga

SEQ ID NO: 967194 - DNA, 25 bp, Mus musculus
tttcatgctacatctttggcactga

SEQ ID NO: 967195 - DNA, 25 bp, Mus musculus
tttcatgctcatatatcctccttgt

SEQ ID NO: 967196 - DNA, 25 bp, Mus musculus
tttcatgctcatttatcctccttgt

SEQ ID NO: 967197 - DNA, 25 bp, Mus musculus
tttcatgctccaccctactgtgttt

SEQ ID NO: 967198 - DNA, 25 bp, Mus musculus
tttcatgctccagcctactgtgttt

SEQ ID NO: 967199 - DNA, 25 bp, Mus musculus
tttcatgctgtgaattctgacatca

SEQ ID NO: 967200 - DNA, 25 bp, Mus musculus
tttcatgctgtgtattctgacatca

SEQ ID NO: 967201 - DNA, 25 bp, Mus musculus
tttcatgcttgcctaaaaaatgctg

SEQ ID NO: 967202 - DNA, 25 bp, Mus musculus
tttcatgcttgcgtaaaaaatgctg

SEQ ID NO: 967203 - DNA, 25 bp, Mus musculus
tttcatgcttgtagaggccgtcact

SEQ ID NO: 967204 - DNA, 25 bp, Mus musculus
tttcatgcttgttgaggccgtcact

SEQ ID NO: 967205 - DNA, 25 bp, Mus musculus
tttcatggactaattgtattttact

SEQ ID NO: 967206 - DNA, 25 bp, Mus musculus
tttcatggactatttgtattttact

SEQ ID NO: 967207 - DNA, 25 bp, Mus musculus
tttcatggagagacactggtactta

SEQ ID NO: 967208 - DNA, 25 bp, Mus musculus
tttcatggagagtcactggtactta

SEQ ID NO: 967209 - DNA, 25 bp, Mus musculus
tttcatggaggtcctagcctttcct

SEQ ID NO: 967210 - DNA, 25 bp, Mus musculus
tttcatggaggtgctagcctttcct

SEQ ID NO: 967211 - DNA, 25 bp, Mus musculus
tttcatggcgatcgccggcaagcag

SEQ ID NO: 967212 - DNA, 25 bp, Mus musculus
tttcatggcgatggccggcaagcag

SEQ ID NO: 967213 - DNA, 25 bp, Mus musculus
tttcatggctaacccacagctcctt

SEQ ID NO: 967214 - DNA, 25 bp, Mus musculus
tttcatggctaagccacagctcctt

SEQ ID NO: 967215 - DNA, 25 bp, Mus musculus
tttcatggctggcaattcaggctct

SEQ ID NO: 967216 - DNA, 25 bp, Mus musculus
tttcatggctgggaattcaggctct

SEQ ID NO: 967217 - DNA, 25 bp, Mus musculus
tttcatggtcatctagctatctctc

SEQ ID NO: 967218 - DNA, 25 bp, Mus musculus
tttcatggtcatgtagctatctctc

SEQ ID NO: 967219 - DNA, 25 bp, Mus musculus
tttcatggtctcctggaaacagttg

SEQ ID NO: 967220 - DNA, 25 bp, Mus musculus
tttcatggtctcgtggaaacagttg

SEQ ID NO: 967221 - DNA, 25 bp, Mus musculus
tttcatggtggtagccccagaggca

SEQ ID NO: 967222 - DNA, 25 bp, Mus musculus
tttcatggtggttgccccagaggca

SEQ ID NO: 967223 - DNA, 25 bp, Mus musculus
tttcatggttccagcccgggagctt

SEQ ID NO: 967224 - DNA, 25 bp, Mus musculus
tttcatggttcctgcccgggagctt

SEQ ID NO: 967225 - DNA, 25 bp, Mus musculus
tttcatggttttcactccctattca

SEQ ID NO: 967226 - DNA, 25 bp, Mus musculus
tttcatggttttgactccctattca

SEQ ID NO: 967227 - DNA, 25 bp, Mus musculus
tttcatgtaattatcagaagccaat

SEQ ID NO: 967228 - DNA, 25 bp, Mus musculus
tttcatgtaattttcagaagccaat

SEQ ID NO: 967229 - DNA, 25 bp, Mus musculus
tttcatgtacctaccttgggtataa

SEQ ID NO: 967230 - DNA, 25 bp, Mus musculus
tttcatgtaccttccttgggtataa

SEQ ID NO: 967231 - DNA, 25 bp, Mus musculus
tttcatgtaggcaatggcttcctgc

SEQ ID NO: 967232 - DNA, 25 bp, Mus musculus
tttcatgtaggctatggcttcctgc

SEQ ID NO: 967233 - DNA, 25 bp, Mus musculus
tttcatgtatgtcctgcccagttcc

SEQ ID NO: 967234 - DNA, 25 bp, Mus musculus
tttcatgtatgtgctgcccagttcc

SEQ ID NO: 967235 - DNA, 25 bp, Mus musculus
tttcatgtcagtcaatcacctggtt

SEQ ID NO: 967236 - DNA, 25 bp, Mus musculus
tttcatgtcagtgaatcacctggtt

SEQ ID NO: 967237 - DNA, 25 bp, Mus musculus
tttcatgtcatcaaattctgagcaa

SEQ ID NO: 967238 - DNA, 25 bp, Mus musculus
tttcatgtcatctaattctgagcaa

SEQ ID NO: 967239 - DNA, 25 bp, Mus musculus
tttcatgtcttcagtgggctgccac

SEQ ID NO: 967240 - DNA, 25 bp, Mus musculus
tttcatgtcttctgtgggctgccac

SEQ ID NO: 967241 - DNA, 25 bp, Mus musculus
tttcatgtggatcgcccatgccaat

SEQ ID NO: 967242 - DNA, 25 bp, Mus musculus
tttcatgtggatggcccatgccaat

SEQ ID NO: 967243 - DNA, 25 bp, Mus musculus
tttcatgtgtgtcaggacctgctga

SEQ ID NO: 967244 - DNA, 25 bp, Mus musculus
tttcatgtgtgtcgtgtcctggttt

SEQ ID NO: 967245 - DNA, 25 bp, Mus musculus
tttcatgtgtgtgaggacctgctga

SEQ ID NO: 967246 - DNA, 25 bp, Mus musculus
tttcatgtgtgtggtgtcctggttt

SEQ ID NO: 967247 - DNA, 25 bp, Mus musculus
tttcatgtgttgaatagacaatgcc

SEQ ID NO: 967248 - DNA, 25 bp, Mus musculus
tttcatgtgttgtatagacaatgcc

SEQ ID NO: 967249 - DNA, 25 bp, Mus musculus
tttcatgttaagcatcacaatccta

SEQ ID NO: 967250 - DNA, 25 bp, Mus musculus
tttcatgttaaggatcacaatccta

SEQ ID NO: 967251 - DNA, 25 bp, Mus musculus
tttcatgttaatattccgagctcaa

SEQ ID NO: 967252 - DNA, 25 bp, Mus musculus
tttcatgttaattttccgagctcaa

SEQ ID NO: 967253 - DNA, 25 bp, Mus musculus
tttcatgttcttaataaccatcaag

SEQ ID NO: 967254 - DNA, 25 bp, Mus musculus
tttcatgttctttataaccatcaag

SEQ ID NO: 967255 - DNA, 25 bp, Mus musculus
tttcatgttggtcgaagtgcatttc

SEQ ID NO: 967256 - DNA, 25 bp, Mus musculus
tttcatgttggtggaagtgcatttc

SEQ ID NO: 967257 - DNA, 25 bp, Mus musculus
tttcatgtttccatcatcatacggg

SEQ ID NO: 967258 - DNA, 25 bp, Mus musculus
tttcatgtttccttcatcatacggg

SEQ ID NO: 967259 - DNA, 25 bp, Mus musculus
tttcatgtttttacgcagtagcttg

SEQ ID NO: 967260 - DNA, 25 bp, Mus musculus
tttcatgttttttcgcagtagcttg

SEQ ID NO: 967261 - DNA, 25 bp, Mus musculus
tttcattaacagcatacacccttta

SEQ ID NO: 967262 - DNA, 25 bp, Mus musculus
tttcattaacaggatacacccttta

SEQ ID NO: 967263 - DNA, 25 bp, Mus musculus
tttcattaacctaagtgtaaggctt

SEQ ID NO: 967264 - DNA, 25 bp, Mus musculus
tttcattaaccttagtgtaaggctt

SEQ ID NO: 967265 - DNA, 25 bp, Mus musculus
tttcattaacttaagccgggtacag

SEQ ID NO: 967266 - DNA, 25 bp, Mus musculus
tttcattaactttagccgggtacag

SEQ ID NO: 967267 - DNA, 25 bp, Mus musculus
tttcattacacaactgtccagcttg

SEQ ID NO: 967268 - DNA, 25 bp, Mus musculus
tttcattacacatctgtccagcttg

SEQ ID NO: 967269 - DNA, 25 bp, Mus musculus
tttcattaccctaaacgacattcgg

SEQ ID NO: 967270 - DNA, 25 bp, Mus musculus
tttcattacccttaacgacattcgg

SEQ ID NO: 967271 - DNA, 25 bp, Mus musculus
tttcattactaaacaagctgcaatt

SEQ ID NO: 967272 - DNA, 25 bp, Mus musculus
tttcattactaatcaagctgcaatt

SEQ ID NO: 967273 - DNA, 25 bp, Mus musculus
tttcattacttgaagcttcaggcag

SEQ ID NO: 967274 - DNA, 25 bp, Mus musculus
tttcattacttgtagcttcaggcag

SEQ ID NO: 967275 - DNA, 25 bp, Mus musculus
tttcattaggtactgcctggctctt

SEQ ID NO: 967276 - DNA, 25 bp, Mus musculus
tttcattaggtagtgcctggctctt

SEQ ID NO: 967277 - DNA, 25 bp, Mus musculus
tttcattatgggagaatgtgcctaa

SEQ ID NO: 967278 - DNA, 25 bp, Mus musculus
tttcattatgggtgaatgtgcctaa

SEQ ID NO: 967279 - DNA, 25 bp, Mus musculus
tttcattattctctggagtcagttg

SEQ ID NO: 967280 - DNA, 25 bp, Mus musculus
tttcattattctgtggagtcagttg

SEQ ID NO: 967281 - DNA, 25 bp, Mus musculus
tttcattattttcgttccctccact

SEQ ID NO: 967282 - DNA, 25 bp, Mus musculus
tttcattattttggttccctccact

SEQ ID NO: 967283 - DNA, 25 bp, Mus musculus
tttcattcaactaaattggctattc

SEQ ID NO: 967284 - DNA, 25 bp, Mus musculus
tttcattcaacttaattggctattc

SEQ ID NO: 967285 - DNA, 25 bp, Mus musculus
tttcattcactgaattagtagacat

SEQ ID NO: 967286 - DNA, 25 bp, Mus musculus
tttcattcactgtattagtagacat

SEQ ID NO: 967287 - DNA, 25 bp, Mus musculus
tttcattcatccaatactctttcct

SEQ ID NO: 967288 - DNA, 25 bp, Mus musculus
tttcattcatcctatactctttcct

SEQ ID NO: 967289 - DNA, 25 bp, Mus musculus
tttcattcatttctcgccataacga

SEQ ID NO: 967290 - DNA, 25 bp, Mus musculus
tttcattcatttgtcgccataacga

SEQ ID NO: 967291 - DNA, 25 bp, Mus musculus
tttcattcccggatggtgtgtggca

SEQ ID NO: 967292 - DNA, 25 bp, Mus musculus
tttcattcccggttggtgtgtggca

SEQ ID NO: 967293 - DNA, 25 bp, Mus musculus
tttcattcctataatttctccagtg

SEQ ID NO: 967294 - DNA, 25 bp, Mus musculus
tttcattcctattatttctccagtg

SEQ ID NO: 967295 - DNA, 25 bp, Mus musculus
tttcattccttgaaaatagcaccag

SEQ ID NO: 967296 - DNA, 25 bp, Mus musculus
tttcattccttgtaaatagcaccag

SEQ ID NO: 967297 - DNA, 25 bp, Mus musculus
tttcattcgacaaaccccttaacaa

SEQ ID NO: 967298 - DNA, 25 bp, Mus musculus
tttcattcgacataccccttaacaa

SEQ ID NO: 967299 - DNA, 25 bp, Mus musculus
tttcattctattattctctttggtt

SEQ ID NO: 967300 - DNA, 25 bp, Mus musculus
tttcattctatttttctctttggtt

SEQ ID NO: 967301 - DNA, 25 bp, Mus musculus
tttcattctcctctgattcaacgta

SEQ ID NO: 967302 - DNA, 25 bp, Mus musculus
tttcattctcctgtgattcaacgta

SEQ ID NO: 967303 - DNA, 25 bp, Mus musculus
tttcattctctgactgatagcaata

SEQ ID NO: 967304 - DNA, 25 bp, Mus musculus
tttcattctctgtctgatagcaata

SEQ ID NO: 967305 - DNA, 25 bp, Mus musculus
tttcattcttcccaagattcctttg

SEQ ID NO: 967306 - DNA, 25 bp, Mus musculus
tttcattcttccgaagattcctttg

SEQ ID NO: 967307 - DNA, 25 bp, Mus musculus
tttcattcttgtatccccatccata

SEQ ID NO: 967308 - DNA, 25 bp, Mus musculus
tttcattcttgtttccccatccata

SEQ ID NO: 967309 - DNA, 25 bp, Mus musculus
tttcattgatgactggctgtgccag

SEQ ID NO: 967310 - DNA, 25 bp, Mus musculus
tttcattgatgagtggctgtgccag

SEQ ID NO: 967311 - DNA, 25 bp, Mus musculus
tttcattgcagtctagattccttac

SEQ ID NO: 967312 - DNA, 25 bp, Mus musculus
tttcattgcagtgtagattccttac

SEQ ID NO: 967313 - DNA, 25 bp, Mus musculus
tttcattgccaaactaaaccggatt

SEQ ID NO: 967314 - DNA, 25 bp, Mus musculus
tttcattgccaatctaaaccggatt

SEQ ID NO: 967315 - DNA, 25 bp, Mus musculus
tttcattgccacacaggtaggctaa

SEQ ID NO: 967316 - DNA, 25 bp, Mus musculus
tttcattgccactcaggtaggctaa

SEQ ID NO: 967317 - DNA, 25 bp, Mus musculus
tttcattggaccctgactgtacaca

SEQ ID NO: 967318 - DNA, 25 bp, Mus musculus
tttcattggaccgtgactgtacaca

SEQ ID NO: 967319 - DNA, 25 bp, Mus musculus
tttcattgtcttcaccttaaacaaa

SEQ ID NO: 967320 - DNA, 25 bp, Mus musculus
tttcattgtcttgaccttaaacaaa

SEQ ID NO: 967321 - DNA, 25 bp, Mus musculus
tttcattgtgacactgtggctaggt

SEQ ID NO: 967322 - DNA, 25 bp, Mus musculus
tttcattgtgactctgtggctaggt

SEQ ID NO: 967323 - DNA, 25 bp, Mus musculus
tttcatttataacgagatgtcacat

SEQ ID NO: 967324 - DNA, 25 bp, Mus musculus
tttcatttataaggagatgtcacat

SEQ ID NO: 967325 - DNA, 25 bp, Mus musculus
tttcatttattcatgcgacccatca

SEQ ID NO: 967326 - DNA, 25 bp, Mus musculus
tttcatttattcttgcgacccatca

SEQ ID NO: 967327 - DNA, 25 bp, Mus musculus
tttcatttccccacatggttttaga

SEQ ID NO: 967328 - DNA, 25 bp, Mus musculus
tttcatttcccctcatggttttaga

SEQ ID NO: 967329 - DNA, 25 bp, Mus musculus
tttcatttcctgaagttaattctgc

SEQ ID NO: 967330 - DNA, 25 bp, Mus musculus
tttcatttcctgtagttaattctgc

SEQ ID NO: 967331 - DNA, 25 bp, Mus musculus
tttcatttctaccactcctagttat

SEQ ID NO: 967332 - DNA, 25 bp, Mus musculus
tttcatttctacgactcctagttat

SEQ ID NO: 967333 - DNA, 25 bp, Mus musculus
tttcatttctatagcccccatgttc

SEQ ID NO: 967334 - DNA, 25 bp, Mus musculus
tttcatttctattgcccccatgttc

SEQ ID NO: 967335 - DNA, 25 bp, Mus musculus
tttcatttctccctttggtcggcac

SEQ ID NO: 967336 - DNA, 25 bp, Mus musculus
tttcatttctccgtttggtcggcac

SEQ ID NO: 967337 - DNA, 25 bp, Mus musculus
tttcatttctctctggcgttgcttc

SEQ ID NO: 967338 - DNA, 25 bp, Mus musculus
tttcatttctctgtggcgttgcttc

SEQ ID NO: 967339 - DNA, 25 bp, Mus musculus
tttcatttgacaccacagtacagtt

SEQ ID NO: 967340 - DNA, 25 bp, Mus musculus
tttcatttgacagcacagtacagtt

SEQ ID NO: 967341 - DNA, 25 bp, Mus musculus
tttcatttgagacgttccccggaat

SEQ ID NO: 967342 - DNA, 25 bp, Mus musculus
tttcatttgagaggttccccggaat

SEQ ID NO: 967343 - DNA, 25 bp, Mus musculus
tttcatttgctcaattgccctaacc

SEQ ID NO: 967344 - DNA, 25 bp, Mus musculus
tttcatttgctctattgccctaacc

SEQ ID NO: 967345 - DNA, 25 bp, Mus musculus
tttcatttgcttaacatggctggta

SEQ ID NO: 967346 - DNA, 25 bp, Mus musculus
tttcatttgctttacatggctggta

SEQ ID NO: 967347 - DNA, 25 bp, Mus musculus
tttcattttcagaagttgatcctaa

SEQ ID NO: 967348 - DNA, 25 bp, Mus musculus
tttcattttcagtagttgatcctaa

SEQ ID NO: 967349 - DNA, 25 bp, Mus musculus
tttcatttttctcccagatatggag

SEQ ID NO: 967350 - DNA, 25 bp, Mus musculus
tttcatttttctgccagatatggag

SEQ ID NO: 967351 - DNA, 25 bp, Mus musculus
tttcattttttactattactatact

SEQ ID NO: 967352 - DNA, 25 bp, Mus musculus
tttcattttttagtattactatact

SEQ ID NO: 967353 - DNA, 25 bp, Mus musculus
tttcattttttcctctgtggttctg

SEQ ID NO: 967354 - DNA, 25 bp, Mus musculus
tttcattttttcgtctgtggttctg

SEQ ID NO: 967355 - DNA, 25 bp, Mus musculus
tttccaaaaacccatatctgagtgt

SEQ ID NO: 967356 - DNA, 25 bp, Mus musculus
tttccaaaaaccgatatctgagtgt

SEQ ID NO: 967357 - DNA, 25 bp, Mus musculus
tttccaaaactgatgccaggcgcta

SEQ ID NO: 967358 - DNA, 25 bp, Mus musculus
tttccaaaactgttgccaggcgcta

SEQ ID NO: 967359 - DNA, 25 bp, Mus musculus
tttccaaacacaccgagctcatttt

SEQ ID NO: 967360 - DNA, 25 bp, Mus musculus
tttccaaacacagcgagctcatttt

SEQ ID NO: 967361 - DNA, 25 bp, Mus musculus
tttccaaacagtaccaggctcgagt

SEQ ID NO: 967362 - DNA, 25 bp, Mus musculus
tttccaaacagttccaggctcgagt

SEQ ID NO: 967363 - DNA, 25 bp, Mus musculus
tttccaaaccgaagggctggctgtc

SEQ ID NO: 967364 - DNA, 25 bp, Mus musculus
tttccaaaccgatgggctggctgtc

SEQ ID NO: 967365 - DNA, 25 bp, Mus musculus
tttccaaacgtgctgagtctgggct

SEQ ID NO: 967366 - DNA, 25 bp, Mus musculus
tttccaaacgtggtgagtctgggct

SEQ ID NO: 967367 - DNA, 25 bp, Mus musculus
tttccaaactcaccctttagcgatt

SEQ ID NO: 967368 - DNA, 25 bp, Mus musculus
tttccaaactcagcctttagcgatt

SEQ ID NO: 967369 - DNA, 25 bp, Mus musculus
tttccaaagagcaaggtgcggctgt

SEQ ID NO: 967370 - DNA, 25 bp, Mus musculus
tttccaaagagctaggtgcggctgt

SEQ ID NO: 967371 - DNA, 25 bp, Mus musculus
tttccaaagcgtctctaatcctgag

SEQ ID NO: 967372 - DNA, 25 bp, Mus musculus
tttccaaagcgtgtctaatcctgag

SEQ ID NO: 967373 - DNA, 25 bp, Mus musculus
tttccaaaggagctaggtctcccat

SEQ ID NO: 967374 - DNA, 25 bp, Mus musculus
tttccaaaggaggtaggtctcccat

SEQ ID NO: 967375 - DNA, 25 bp, Mus musculus
tttccaaaggccatgcctaatcttc

SEQ ID NO: 967376 - DNA, 25 bp, Mus musculus
tttccaaaggccttgcctaatcttc

SEQ ID NO: 967377 - DNA, 25 bp, Mus musculus
tttccaaatctgctagggctacaaa

SEQ ID NO: 967378 - DNA, 25 bp, Mus musculus
tttccaaatctggtagggctacaaa

SEQ ID NO: 967379 - DNA, 25 bp, Mus musculus
tttccaaattatcaaggtatatcag

SEQ ID NO: 967380 - DNA, 25 bp, Mus musculus
tttccaaattatgaaggtatatcag

SEQ ID NO: 967381 - DNA, 25 bp, Mus musculus
tttccaacaatcacatgaaggttcc

SEQ ID NO: 967382 - DNA, 25 bp, Mus musculus
tttccaacaatctcatgaaggttcc

SEQ ID NO: 967383 - DNA, 25 bp, Mus musculus
tttccaacagcgcagccacagtggt

SEQ ID NO: 967384 - DNA, 25 bp, Mus musculus
tttccaacagcggagccacagtggt

SEQ ID NO: 967385 - DNA, 25 bp, Mus musculus
tttccaacagtcctgaggctcatgc

SEQ ID NO: 967386 - DNA, 25 bp, Mus musculus
tttccaacagtcgtgaggctcatgc

SEQ ID NO: 967387 - DNA, 25 bp, Mus musculus
tttccaaccaacataaactcccatt

SEQ ID NO: 967388 - DNA, 25 bp, Mus musculus
tttccaaccaacttaaactcccatt

SEQ ID NO: 967389 - DNA, 25 bp, Mus musculus
tttccaaccacaagcgagcctagaa

SEQ ID NO: 967390 - DNA, 25 bp, Mus musculus
tttccaaccacatgcgagcctagaa

SEQ ID NO: 967391 - DNA, 25 bp, Mus musculus
tttccaaccgttcaagggcactaca

SEQ ID NO: 967392 - DNA, 25 bp, Mus musculus
tttccaaccgttgaagggcactaca

SEQ ID NO: 967393 - DNA, 25 bp, Mus musculus
tttccaacctatcttccagcctttt

SEQ ID NO: 967394 - DNA, 25 bp, Mus musculus
tttccaacctatgttccagcctttt

SEQ ID NO: 967395 - DNA, 25 bp, Mus musculus
tttccaacctctatcccaatttaat

SEQ ID NO: 967396 - DNA, 25 bp, Mus musculus
tttccaacctctttcccaatttaat

SEQ ID NO: 967397 - DNA, 25 bp, Mus musculus
tttccaacctggaagggctgcttca

SEQ ID NO: 967398 - DNA, 25 bp, Mus musculus
tttccaacctggtagggctgcttca

SEQ ID NO: 967399 - DNA, 25 bp, Mus musculus
tttccaaccttacctgaaccaggaa

SEQ ID NO: 967400 - DNA, 25 bp, Mus musculus
tttccaaccttagctgaaccaggaa

SEQ ID NO: 967401 - DNA, 25 bp, Mus musculus
tttccaactatgaggctcccaaaac

SEQ ID NO: 967402 - DNA, 25 bp, Mus musculus
tttccaactatgtggctcccaaaac

SEQ ID NO: 967403 - DNA, 25 bp, Mus musculus
tttccaactcagatgtattttgttt

SEQ ID NO: 967404 - DNA, 25 bp, Mus musculus
tttccaactcagttgtattttgttt

SEQ ID NO: 967405 - DNA, 25 bp, Mus musculus
tttccaactttgatgccagttacat

SEQ ID NO: 967406 - DNA, 25 bp, Mus musculus
tttccaactttgttgccagttacat

SEQ ID NO: 967407 - DNA, 25 bp, Mus musculus
tttccaagaagaaaacaatgtgagg

SEQ ID NO: 967408 - DNA, 25 bp, Mus musculus
tttccaagaagataacaatgtgagg

SEQ ID NO: 967409 - DNA, 25 bp, Mus musculus
tttccaagagccctgataaccttga

SEQ ID NO: 967410 - DNA, 25 bp, Mus musculus
tttccaagagccgtgataaccttga

SEQ ID NO: 967411 - DNA, 25 bp, Mus musculus
tttccaagatacatctcactctgtg

SEQ ID NO: 967412 - DNA, 25 bp, Mus musculus
tttccaagatacttctcactctgtg

SEQ ID NO: 967413 - DNA, 25 bp, Mus musculus
tttccaagcccaatctccagagcaa

SEQ ID NO: 967414 - DNA, 25 bp, Mus musculus
tttccaagcccattctccagagcaa

SEQ ID NO: 967415 - DNA, 25 bp, Mus musculus
tttccaaggccaacatccaggtgaa

SEQ ID NO: 967416 - DNA, 25 bp, Mus musculus
tttccaaggccaattctcaaccctt

SEQ ID NO: 967417 - DNA, 25 bp, Mus musculus
tttccaaggccatcatccaggtgaa

SEQ ID NO: 967418 - DNA, 25 bp, Mus musculus
tttccaaggccatttctcaaccctt

SEQ ID NO: 967419 - DNA, 25 bp, Mus musculus
tttccaaggctgcaaagggtttctc

SEQ ID NO: 967420 - DNA, 25 bp, Mus musculus
tttccaaggctggaaagggtttctc

SEQ ID NO: 967421 - DNA, 25 bp, Mus musculus
tttccaagtccaaatcctggaggca

SEQ ID NO: 967422 - DNA, 25 bp, Mus musculus
tttccaagtccacttcttagaggga

SEQ ID NO: 967423 - DNA, 25 bp, Mus musculus
tttccaagtccagttcttagaggga

SEQ ID NO: 967424 - DNA, 25 bp, Mus musculus
tttccaagtccatatcctggaggca

SEQ ID NO: 967425 - DNA, 25 bp, Mus musculus
tttccaagtctgacttaactggccg

SEQ ID NO: 967426 - DNA, 25 bp, Mus musculus
tttccaagtctgtcttaactggccg

SEQ ID NO: 967427 - DNA, 25 bp, Mus musculus
tttccaagtgccaaagagcccagaa

SEQ ID NO: 967428 - DNA, 25 bp, Mus musculus
tttccaagtgccattgcgatggccc

SEQ ID NO: 967429 - DNA, 25 bp, Mus musculus
tttccaagtgcctaagagcccagaa

SEQ ID NO: 967430 - DNA, 25 bp, Mus musculus
tttccaagtgcctttgcgatggccc

SEQ ID NO: 967431 - DNA, 25 bp, Mus musculus
tttccaagtgctatgctttcagatt

SEQ ID NO: 967432 - DNA, 25 bp, Mus musculus
tttccaagtgctttgctttcagatt

SEQ ID NO: 967433 - DNA, 25 bp, Mus musculus
tttccaagtgtgctgaagacctgct

SEQ ID NO: 967434 - DNA, 25 bp, Mus musculus
tttccaagtgtggtgaagacctgct

SEQ ID NO: 967435 - DNA, 25 bp, Mus musculus
tttccaagttacatttactgcagac

SEQ ID NO: 967436 - DNA, 25 bp, Mus musculus
tttccaagttacttttactgcagac

SEQ ID NO: 967437 - DNA, 25 bp, Mus musculus
tttccaagttggcacttccagcacc

SEQ ID NO: 967438 - DNA, 25 bp, Mus musculus
tttccaagttgggacttccagcacc

SEQ ID NO: 967439 - DNA, 25 bp, Mus musculus
tttccaatagaaagcctggcctctc

SEQ ID NO: 967440 - DNA, 25 bp, Mus musculus
tttccaatagaatgcctggcctctc

SEQ ID NO: 967441 - DNA, 25 bp, Mus musculus
tttccaatagatatcattcttgtca

SEQ ID NO: 967442 - DNA, 25 bp, Mus musculus
tttccaatagatttcattcttgtca

SEQ ID NO: 967443 - DNA, 25 bp, Mus musculus
tttccaataggaaagctcctgctgt

SEQ ID NO: 967444 - DNA, 25 bp, Mus musculus
tttccaataggatagctcctgctgt

SEQ ID NO: 967445 - DNA, 25 bp, Mus musculus
tttccaatcccgcttattacataat

SEQ ID NO: 967446 - DNA, 25 bp, Mus musculus
tttccaatcccggttattacataat

SEQ ID NO: 967447 - DNA, 25 bp, Mus musculus
tttccaatccctaacaactgtgact

SEQ ID NO: 967448 - DNA, 25 bp, Mus musculus
tttccaatcccttacaactgtgact

SEQ ID NO: 967449 - DNA, 25 bp, Mus musculus
tttccaattattccgagccttgact

SEQ ID NO: 967450 - DNA, 25 bp, Mus musculus
tttccaattattgcgagccttgact

SEQ ID NO: 967451 - DNA, 25 bp, Mus musculus
tttccaattggacagatcttgagaa

SEQ ID NO: 967452 - DNA, 25 bp, Mus musculus
tttccaattggagagatcttgagaa

SEQ ID NO: 967453 - DNA, 25 bp, Mus musculus
tttccacaagatcaaactgtaggga

SEQ ID NO: 967454 - DNA, 25 bp, Mus musculus
tttccacaagatgaaactgtaggga

SEQ ID NO: 967455 - DNA, 25 bp, Mus musculus
tttccacaatctcaaggccggcctt

SEQ ID NO: 967456 - DNA, 25 bp, Mus musculus
tttccacaatctgaaggccggcctt

SEQ ID NO: 967457 - DNA, 25 bp, Mus musculus
tttccacacaaacagccattgcttt

SEQ ID NO: 967458 - DNA, 25 bp, Mus musculus
tttccacacaaagagccattgcttt

SEQ ID NO: 967459 - DNA, 25 bp, Mus musculus
tttccacacactatttctccaatat

SEQ ID NO: 967460 - DNA, 25 bp, Mus musculus
tttccacacactttttctccaatat

SEQ ID NO: 967461 - DNA, 25 bp, Mus musculus
tttccacacagaacttctcaaggct

SEQ ID NO: 967462 - DNA, 25 bp, Mus musculus
tttccacacagatcttctcaaggct

SEQ ID NO: 967463 - DNA, 25 bp, Mus musculus
tttccacaccacactgtgttatttt

SEQ ID NO: 967464 - DNA, 25 bp, Mus musculus
tttccacaccactctgtgttatttt

SEQ ID NO: 967465 - DNA, 25 bp, Mus musculus
tttccacacgtgcatttaataaaat

SEQ ID NO: 967466 - DNA, 25 bp, Mus musculus
tttccacacgtggatttaataaaat

SEQ ID NO: 967467 - DNA, 25 bp, Mus musculus
tttccacacgttcagacagtctagt

SEQ ID NO: 967468 - DNA, 25 bp, Mus musculus
tttccacacgttgagacagtctagt

SEQ ID NO: 967469 - DNA, 25 bp, Mus musculus
tttccacagaacagggtcacagatc

SEQ ID NO: 967470 - DNA, 25 bp, Mus musculus
tttccacagaactgggtcacagatc

SEQ ID NO: 967471 - DNA, 25 bp, Mus musculus
tttccacagatgacttgctggactc

SEQ ID NO: 967472 - DNA, 25 bp, Mus musculus
tttccacagatgtcttgctggactc

SEQ ID NO: 967473 - DNA, 25 bp, Mus musculus
tttccacagcctctttatctttgca

SEQ ID NO: 967474 - DNA, 25 bp, Mus musculus
tttccacagcctgtttatctttgca

SEQ ID NO: 967475 - DNA, 25 bp, Mus musculus
tttccacagcgtaccattaggagtt

SEQ ID NO: 967476 - DNA, 25 bp, Mus musculus
tttccacagcgttccattaggagtt

SEQ ID NO: 967477 - DNA, 25 bp, Mus musculus
tttccacagtgtaaacccatataga

SEQ ID NO: 967478 - DNA, 25 bp, Mus musculus
tttccacagtgttaacccatataga

SEQ ID NO: 967479 - DNA, 25 bp, Mus musculus
tttccacataccataggcttcccgg

SEQ ID NO: 967480 - DNA, 25 bp, Mus musculus
tttccacataccttaggcttcccgg

SEQ ID NO: 967481 - DNA, 25 bp, Mus musculus
tttccacatataaggctatgctacc

SEQ ID NO: 967482 - DNA, 25 bp, Mus musculus
tttccacatatatggctatgctacc

SEQ ID NO: 967483 - DNA, 25 bp, Mus musculus
tttccacatcggctgttacaagtgt

SEQ ID NO: 967484 - DNA, 25 bp, Mus musculus
tttccacatcgggtgttacaagtgt

SEQ ID NO: 967485 - DNA, 25 bp, Mus musculus
tttccacatcttcaaacatgcccat

SEQ ID NO: 967486 - DNA, 25 bp, Mus musculus
tttccacatcttgaaacatgcccat

SEQ ID NO: 967487 - DNA, 25 bp, Mus musculus
tttccacatggaaaacacgcatctt

SEQ ID NO: 967488 - DNA, 25 bp, Mus musculus
tttccacatggataacacgcatctt

SEQ ID NO: 967489 - DNA, 25 bp, Mus musculus
tttccaccaacccaagagctaagaa

SEQ ID NO: 967490 - DNA, 25 bp, Mus musculus
tttccaccaaccgaagagctaagaa

SEQ ID NO: 967491 - DNA, 25 bp, Mus musculus
tttccaccaactccaaaggacctag

SEQ ID NO: 967492 - DNA, 25 bp, Mus musculus
tttccaccaactccagcaattaaag

SEQ ID NO: 967493 - DNA, 25 bp, Mus musculus
tttccaccaactgcaaaggacctag

SEQ ID NO: 967494 - DNA, 25 bp, Mus musculus
tttccaccaactgcagcaattaaag

SEQ ID NO: 967495 - DNA, 25 bp, Mus musculus
tttccaccagctagattcctgaact

SEQ ID NO: 967496 - DNA, 25 bp, Mus musculus
tttccaccagcttgattcctgaact

SEQ ID NO: 967497 - DNA, 25 bp, Mus musculus
tttccaccatgaccactcaagtaga

SEQ ID NO: 967498 - DNA, 25 bp, Mus musculus
tttccaccatgagcactcaagtaga

SEQ ID NO: 967499 - DNA, 25 bp, Mus musculus
tttccaccatttcgccacttagatt

SEQ ID NO: 967500 - DNA, 25 bp, Mus musculus
tttccaccatttggccacttagatt

SEQ ID NO: 967501 - DNA, 25 bp, Mus musculus
tttccacccaaaagccattgtctat

SEQ ID NO: 967502 - DNA, 25 bp, Mus musculus
tttccacccaaatgccattgtctat

SEQ ID NO: 967503 - DNA, 25 bp, Mus musculus
tttccacccatgactagcttggagt

SEQ ID NO: 967504 - DNA, 25 bp, Mus musculus
tttccacccatgtctagcttggagt

SEQ ID NO: 967505 - DNA, 25 bp, Mus musculus
tttccacccattcagaggacgcaga

SEQ ID NO: 967506 - DNA, 25 bp, Mus musculus
tttccacccattgagaggacgcaga

SEQ ID NO: 967507 - DNA, 25 bp, Mus musculus
tttccaccccagcatttctttgcat

SEQ ID NO: 967508 - DNA, 25 bp, Mus musculus
tttccaccccaggatttctttgcat

SEQ ID NO: 967509 - DNA, 25 bp, Mus musculus
tttccacccctaatcttacaattag

SEQ ID NO: 967510 - DNA, 25 bp, Mus musculus
tttccacccctattcttacaattag

SEQ ID NO: 967511 - DNA, 25 bp, Mus musculus
tttccacccgagattctagtcaagt

SEQ ID NO: 967512 - DNA, 25 bp, Mus musculus
tttccacccgagtttctagtcaagt

SEQ ID NO: 967513 - DNA, 25 bp, Mus musculus
tttccaccctgaacttgtgataggt

SEQ ID NO: 967514 - DNA, 25 bp, Mus musculus
tttccaccctgatcttgtgataggt

SEQ ID NO: 967515 - DNA, 25 bp, Mus musculus
tttccaccctttcagcagtgcagtg

SEQ ID NO: 967516 - DNA, 25 bp, Mus musculus
tttccaccctttgagcagtgcagtg

SEQ ID NO: 967517 - DNA, 25 bp, Mus musculus
tttccaccgtatctgcagggaggac

SEQ ID NO: 967518 - DNA, 25 bp, Mus musculus
tttccaccgtatgtgcagggaggac

SEQ ID NO: 967519 - DNA, 25 bp, Mus musculus
tttccacctgcacgtgggctcagca

SEQ ID NO: 967520 - DNA, 25 bp, Mus musculus
tttccacctgcaggtgggctcagca

SEQ ID NO: 967521 - DNA, 25 bp, Mus musculus
tttccacctggcatagttcagctta

SEQ ID NO: 967522 - DNA, 25 bp, Mus musculus
tttccacctggcttagttcagctta

SEQ ID NO: 967523 - DNA, 25 bp, Mus musculus
tttccacctttgagtgagtgtgtat

SEQ ID NO: 967524 - DNA, 25 bp, Mus musculus
tttccacctttgtgtgagtgtgtat

SEQ ID NO: 967525 - DNA, 25 bp, Mus musculus
tttccaccttttaagctgtgactgg

SEQ ID NO: 967526 - DNA, 25 bp, Mus musculus
tttccacctttttagctgtgactgg

SEQ ID NO: 967527 - DNA, 25 bp, Mus musculus
tttccacgagaacctaccaaaagct

SEQ ID NO: 967528 - DNA, 25 bp, Mus musculus
tttccacgagaagctaccaaaagct

SEQ ID NO: 967529 - DNA, 25 bp, Mus musculus
tttccacgattacctttgcagacca

SEQ ID NO: 967530 - DNA, 25 bp, Mus musculus
tttccacgattagctttgcagacca

SEQ ID NO: 967531 - DNA, 25 bp, Mus musculus
tttccacgcatgcacactttgagat

SEQ ID NO: 967532 - DNA, 25 bp, Mus musculus
tttccacgcatggacactttgagat

SEQ ID NO: 967533 - DNA, 25 bp, Mus musculus
tttccacgcgcgaccgaagggtgtg

SEQ ID NO: 967534 - DNA, 25 bp, Mus musculus
tttccacgcgcgtccgaagggtgtg

SEQ ID NO: 967535 - DNA, 25 bp, Mus musculus
tttccacggaagacatagccagcaa

SEQ ID NO: 967536 - DNA, 25 bp, Mus musculus
tttccacggaagtcatagccagcaa

SEQ ID NO: 967537 - DNA, 25 bp, Mus musculus
tttccacggaggcagagcatagcta

SEQ ID NO: 967538 - DNA, 25 bp, Mus musculus
tttccacggagggagagcatagcta

SEQ ID NO: 967539 - DNA, 25 bp, Mus musculus
tttccacgggacagtaacccagctg

SEQ ID NO: 967540 - DNA, 25 bp, Mus musculus
tttccacgggactgtaacccagctg

SEQ ID NO: 967541 - DNA, 25 bp, Mus musculus
tttccacggtctaaaaatgctccat

SEQ ID NO: 967542 - DNA, 25 bp, Mus musculus
tttccacggtcttaaaatgctccat

SEQ ID NO: 967543 - DNA, 25 bp, Mus musculus
tttccacggtgtctaaagtccttgt

SEQ ID NO: 967544 - DNA, 25 bp, Mus musculus
tttccacggtgtgtaaagtccttgt

SEQ ID NO: 967545 - DNA, 25 bp, Mus musculus
tttccacgtgaaaacatgtacttga

SEQ ID NO: 967546 - DNA, 25 bp, Mus musculus
tttccacgtgaatacatgtacttga

SEQ ID NO: 967547 - DNA, 25 bp, Mus musculus
tttccacgtgcactgggaccagaag

SEQ ID NO: 967548 - DNA, 25 bp, Mus musculus
tttccacgtgcagtgggaccagaag

SEQ ID NO: 967549 - DNA, 25 bp, Mus musculus
tttccacgtggaacgagggttagag

SEQ ID NO: 967550 - DNA, 25 bp, Mus musculus
tttccacgtggatcgagggttagag

SEQ ID NO: 967551 - DNA, 25 bp, Mus musculus
tttccactaaccctatcaggcaagc

SEQ ID NO: 967552 - DNA, 25 bp, Mus musculus
tttccactaaccgtatcaggcaagc

SEQ ID NO: 967553 - DNA, 25 bp, Mus musculus
tttccactacagaccgtggctgtaa

SEQ ID NO: 967554 - DNA, 25 bp, Mus musculus
tttccactacagtccgtggctgtaa

SEQ ID NO: 967555 - DNA, 25 bp, Mus musculus
tttccactatttcgtattccttaga

SEQ ID NO: 967556 - DNA, 25 bp, Mus musculus
tttccactatttggtattccttaga

SEQ ID NO: 967557 - DNA, 25 bp, Mus musculus
tttccactcacaagttcagacacgt

SEQ ID NO: 967558 - DNA, 25 bp, Mus musculus
tttccactcacatgttcagacacgt

SEQ ID NO: 967559 - DNA, 25 bp, Mus musculus
tttccactcctccttttcaggatat

SEQ ID NO: 967560 - DNA, 25 bp, Mus musculus
tttccactcctcgttttcaggatat

SEQ ID NO: 967561 - DNA, 25 bp, Mus musculus
tttccactcggtagacaggcaggca

SEQ ID NO: 967562 - DNA, 25 bp, Mus musculus
tttccactcggttgacaggcaggca

SEQ ID NO: 967563 - DNA, 25 bp, Mus musculus
tttccactcgttcgctggacctaaa

SEQ ID NO: 967564 - DNA, 25 bp, Mus musculus
tttccactcgttggctggacctaaa

SEQ ID NO: 967565 - DNA, 25 bp, Mus musculus
tttccactctggatgggaccctgaa

SEQ ID NO: 967566 - DNA, 25 bp, Mus musculus
tttccactctggttgggaccctgaa

SEQ ID NO: 967567 - DNA, 25 bp, Mus musculus
tttccactcttaaggccatcaggga

SEQ ID NO: 967568 - DNA, 25 bp, Mus musculus
tttccactcttatggccatcaggga

SEQ ID NO: 967569 - DNA, 25 bp, Mus musculus
tttccactggatcaccttactgtac

SEQ ID NO: 967570 - DNA, 25 bp, Mus musculus
tttccactggatcctttccttattt

SEQ ID NO: 967571 - DNA, 25 bp, Mus musculus
tttccactggatgaccttactgtac

SEQ ID NO: 967572 - DNA, 25 bp, Mus musculus
tttccactggatgctttccttattt

SEQ ID NO: 967573 - DNA, 25 bp, Mus musculus
tttccactgggaagcgattctgctt

SEQ ID NO: 967574 - DNA, 25 bp, Mus musculus
tttccactgggatgcgattctgctt

SEQ ID NO: 967575 - DNA, 25 bp, Mus musculus
tttccactggttcatttctgatctc

SEQ ID NO: 967576 - DNA, 25 bp, Mus musculus
tttccactggttgatttctgatctc

SEQ ID NO: 967577 - DNA, 25 bp, Mus musculus
tttccactgtagaattttgccctct

SEQ ID NO: 967578 - DNA, 25 bp, Mus musculus
tttccactgtagtattttgccctct

SEQ ID NO: 967579 - DNA, 25 bp, Mus musculus
tttccactgtcacacgcatagatct

SEQ ID NO: 967580 - DNA, 25 bp, Mus musculus
tttccactgtcagacgcatagatct

SEQ ID NO: 967581 - DNA, 25 bp, Mus musculus
tttccactgtctcttcattgacaac

SEQ ID NO: 967582 - DNA, 25 bp, Mus musculus
tttccactgtctgttcattgacaac

SEQ ID NO: 967583 - DNA, 25 bp, Mus musculus
tttccactgttaactttccttctta

SEQ ID NO: 967584 - DNA, 25 bp, Mus musculus
tttccactgttatctttccttctta

SEQ ID NO: 967585 - DNA, 25 bp, Mus musculus
tttccacttactaggccaccttaat

SEQ ID NO: 967586 - DNA, 25 bp, Mus musculus
tttccacttacttggccaccttaat

SEQ ID NO: 967587 - DNA, 25 bp, Mus musculus
tttccacttaggattctctaatcat

SEQ ID NO: 967588 - DNA, 25 bp, Mus musculus
tttccacttaggtttctctaatcat

SEQ ID NO: 967589 - DNA, 25 bp, Mus musculus
tttccacttatacagactgaaaaag

SEQ ID NO: 967590 - DNA, 25 bp, Mus musculus
tttccacttatagagactgaaaaag

SEQ ID NO: 967591 - DNA, 25 bp, Mus musculus
tttccacttctgatataatcaatgt

SEQ ID NO: 967592 - DNA, 25 bp, Mus musculus
tttccacttctgctggataagctca

SEQ ID NO: 967593 - DNA, 25 bp, Mus musculus
tttccacttctggtggataagctca

SEQ ID NO: 967594 - DNA, 25 bp, Mus musculus
tttccacttctgttataatcaatgt

SEQ ID NO: 967595 - DNA, 25 bp, Mus musculus
tttccacttgaacagttacatttcg

SEQ ID NO: 967596 - DNA, 25 bp, Mus musculus
tttccacttgaagagttacatttcg

SEQ ID NO: 967597 - DNA, 25 bp, Mus musculus
tttccacttggaaccacagggacga

SEQ ID NO: 967598 - DNA, 25 bp, Mus musculus
tttccacttggatccacagggacga

SEQ ID NO: 967599 - DNA, 25 bp, Mus musculus
tttccactttacatgaagagactga

SEQ ID NO: 967600 - DNA, 25 bp, Mus musculus
tttccactttacttgaagagactga

SEQ ID NO: 967601 - DNA, 25 bp, Mus musculus
tttccactttccaataccatccatt

SEQ ID NO: 967602 - DNA, 25 bp, Mus musculus
tttccactttcctataccatccatt

SEQ ID NO: 967603 - DNA, 25 bp, Mus musculus
tttccactttctctcatcactgagg

SEQ ID NO: 967604 - DNA, 25 bp, Mus musculus
tttccactttctgtcatcactgagg

SEQ ID NO: 967605 - DNA, 25 bp, Mus musculus
tttccagaaaatccaagtccggcta

SEQ ID NO: 967606 - DNA, 25 bp, Mus musculus
tttccagaaaatgcaagtccggcta

SEQ ID NO: 967607 - DNA, 25 bp, Mus musculus
tttccagaaagtctggttatgttct

SEQ ID NO: 967608 - DNA, 25 bp, Mus musculus
tttccagaaagtgtggttatgttct

SEQ ID NO: 967609 - DNA, 25 bp, Mus musculus
tttccagaacacagcatccggtttg

SEQ ID NO: 967610 - DNA, 25 bp, Mus musculus
tttccagaacactgcatccggtttg

SEQ ID NO: 967611 - DNA, 25 bp, Mus musculus
tttccagaaccactgagagctcctt

SEQ ID NO: 967612 - DNA, 25 bp, Mus musculus
tttccagaaccagtgagagctcctt

SEQ ID NO: 967613 - DNA, 25 bp, Mus musculus
tttccagaagcgaagccaccaccgt

SEQ ID NO: 967614 - DNA, 25 bp, Mus musculus
tttccagaagcgtagccaccaccgt

SEQ ID NO: 967615 - DNA, 25 bp, Mus musculus
tttccagaagttatcctctgatatc

SEQ ID NO: 967616 - DNA, 25 bp, Mus musculus
tttccagaagttttcctctgatatc

SEQ ID NO: 967617 - DNA, 25 bp, Mus musculus
tttccagaatagcattcacagctgt

SEQ ID NO: 967618 - DNA, 25 bp, Mus musculus
tttccagaataggattcacagctgt

SEQ ID NO: 967619 - DNA, 25 bp, Mus musculus
tttccagaatctaaaattaggtgag

SEQ ID NO: 967620 - DNA, 25 bp, Mus musculus
tttccagaatctcaaggtcctcttg

SEQ ID NO: 967621 - DNA, 25 bp, Mus musculus
tttccagaatctgaaggtcctcttg

SEQ ID NO: 967622 - DNA, 25 bp, Mus musculus
tttccagaatcttaaattaggtgag

SEQ ID NO: 967623 - DNA, 25 bp, Mus musculus
tttccagacataattgcgctcacgt

SEQ ID NO: 967624 - DNA, 25 bp, Mus musculus
tttccagacatatttgcgctcacgt

SEQ ID NO: 967625 - DNA, 25 bp, Mus musculus
tttccagaccacacacgagacatta

SEQ ID NO: 967626 - DNA, 25 bp, Mus musculus
tttccagaccactcacgagacatta

SEQ ID NO: 967627 - DNA, 25 bp, Mus musculus
tttccagacgtaactgtgaaatgga

SEQ ID NO: 967628 - DNA, 25 bp, Mus musculus
tttccagacgtatctgtgaaatgga

SEQ ID NO: 967629 - DNA, 25 bp, Mus musculus
tttccagactcaaatcaggtgttca

SEQ ID NO: 967630 - DNA, 25 bp, Mus musculus
tttccagactcatatcaggtgttca

SEQ ID NO: 967631 - DNA, 25 bp, Mus musculus
tttccagagatgaggctcagcggct

SEQ ID NO: 967632 - DNA, 25 bp, Mus musculus
tttccagagatgtggctcagcggct

SEQ ID NO: 967633 - DNA, 25 bp, Mus musculus
tttccagagattccagggccagcaa

SEQ ID NO: 967634 - DNA, 25 bp, Mus musculus
tttccagagattgcagggccagcaa

SEQ ID NO: 967635 - DNA, 25 bp, Mus musculus
tttccagagcacctgaattgagttc

SEQ ID NO: 967636 - DNA, 25 bp, Mus musculus
tttccagagcacgtgaattgagttc

SEQ ID NO: 967637 - DNA, 25 bp, Mus musculus
tttccagagcttctggaccccgcaa

SEQ ID NO: 967638 - DNA, 25 bp, Mus musculus
tttccagagcttgtggaccccgcaa

SEQ ID NO: 967639 - DNA, 25 bp, Mus musculus
tttccagaggaacgacacgacctgc

SEQ ID NO: 967640 - DNA, 25 bp, Mus musculus
tttccagaggaaggacacgacctgc

SEQ ID NO: 967641 - DNA, 25 bp, Mus musculus
tttccagagggtctcaccttgcaga

SEQ ID NO: 967642 - DNA, 25 bp, Mus musculus
tttccagagggtgtcaccttgcaga

SEQ ID NO: 967643 - DNA, 25 bp, Mus musculus
tttccagagtggaaacctagaaaag

SEQ ID NO: 967644 - DNA, 25 bp, Mus musculus
tttccagagtggtaacctagaaaag

SEQ ID NO: 967645 - DNA, 25 bp, Mus musculus
tttccagatagcaaccggttcttcg

SEQ ID NO: 967646 - DNA, 25 bp, Mus musculus
tttccagatagctaccggttcttcg

SEQ ID NO: 967647 - DNA, 25 bp, Mus musculus
tttccagatcctactcgaacaggaa

SEQ ID NO: 967648 - DNA, 25 bp, Mus musculus
tttccagatccttctcgaacaggaa

SEQ ID NO: 967649 - DNA, 25 bp, Mus musculus
tttccagatctgatacaaacccctc

SEQ ID NO: 967650 - DNA, 25 bp, Mus musculus
tttccagatctgttacaaacccctc

SEQ ID NO: 967651 - DNA, 25 bp, Mus musculus
tttccagatcttccctaagtgaatg

SEQ ID NO: 967652 - DNA, 25 bp, Mus musculus
tttccagatcttgcctaagtgaatg

SEQ ID NO: 967653 - DNA, 25 bp, Mus musculus
tttccagatgaaatgtgcagagtgt

SEQ ID NO: 967654 - DNA, 25 bp, Mus musculus
tttccagatgaattgtgcagagtgt

SEQ ID NO: 967655 - DNA, 25 bp, Mus musculus
tttccagatgcaaggcctacacagt

SEQ ID NO: 967656 - DNA, 25 bp, Mus musculus
tttccagatgcatggcctacacagt

SEQ ID NO: 967657 - DNA, 25 bp, Mus musculus
tttccagattcgaggcccaggtgat

SEQ ID NO: 967658 - DNA, 25 bp, Mus musculus
tttccagattcgtggcccaggtgat

SEQ ID NO: 967659 - DNA, 25 bp, Mus musculus
tttccagatttaaccgcatcattcc

SEQ ID NO: 967660 - DNA, 25 bp, Mus musculus
tttccagatttatccgcatcattcc

SEQ ID NO: 967661 - DNA, 25 bp, Mus musculus
tttccagcacacatattgggtggct

SEQ ID NO: 967662 - DNA, 25 bp, Mus musculus
tttccagcacacttattgggtggct

SEQ ID NO: 967663 - DNA, 25 bp, Mus musculus
tttccagcaccacgttgtagacgtt

SEQ ID NO: 967664 - DNA, 25 bp, Mus musculus
tttccagcaccaggttgtagacgtt

SEQ ID NO: 967665 - DNA, 25 bp, Mus musculus
tttccagcagaaacacttcatccgt

SEQ ID NO: 967666 - DNA, 25 bp, Mus musculus
tttccagcagaatcacttcatccgt

SEQ ID NO: 967667 - DNA, 25 bp, Mus musculus
tttccagcagcacgtgatgaactgt

SEQ ID NO: 967668 - DNA, 25 bp, Mus musculus
tttccagcagcaggtgatgaactgt

SEQ ID NO: 967669 - DNA, 25 bp, Mus musculus
tttccagcagtcacattgcccaggt

SEQ ID NO: 967670 - DNA, 25 bp, Mus musculus
tttccagcagtctcattgcccaggt

SEQ ID NO: 967671 - DNA, 25 bp, Mus musculus
tttccagccagacactcggaagatg

SEQ ID NO: 967672 - DNA, 25 bp, Mus musculus
tttccagccagagactcggaagatg

SEQ ID NO: 967673 - DNA, 25 bp, Mus musculus
tttccagccagcattcaaataagat

SEQ ID NO: 967674 - DNA, 25 bp, Mus musculus
tttccagccagctttcaaataagat

SEQ ID NO: 967675 - DNA, 25 bp, Mus musculus
tttccagccatgactgacagtgagc

SEQ ID NO: 967676 - DNA, 25 bp, Mus musculus
tttccagccatgtctgacagtgagc

SEQ ID NO: 967677 - DNA, 25 bp, Mus musculus
tttccagccccaaaattgtagcttc

SEQ ID NO: 967678 - DNA, 25 bp, Mus musculus
tttccagccccactactgtgtattt

SEQ ID NO: 967679 - DNA, 25 bp, Mus musculus
tttccagccccagtactgtgtattt

SEQ ID NO: 967680 - DNA, 25 bp, Mus musculus
tttccagccccataattgtagcttc

SEQ ID NO: 967681 - DNA, 25 bp, Mus musculus
tttccagccctactggagacttggt

SEQ ID NO: 967682 - DNA, 25 bp, Mus musculus
tttccagccctagtggagacttggt

SEQ ID NO: 967683 - DNA, 25 bp, Mus musculus
tttccagcgcatacagggtggcact

SEQ ID NO: 967684 - DNA, 25 bp, Mus musculus
tttccagcgcattcagggtggcact

SEQ ID NO: 967685 - DNA, 25 bp, Mus musculus
tttccagcgctgagtattttgcaga

SEQ ID NO: 967686 - DNA, 25 bp, Mus musculus
tttccagcgctgtgtattttgcaga

SEQ ID NO: 967687 - DNA, 25 bp, Mus musculus
tttccagcgtccataggaatggcgt

SEQ ID NO: 967688 - DNA, 25 bp, Mus musculus
tttccagcgtccttaggaatggcgt

SEQ ID NO: 967689 - DNA, 25 bp, Mus musculus
tttccagctacaaattcctttcaag

SEQ ID NO: 967690 - DNA, 25 bp, Mus musculus
tttccagctacactggcagttctca

SEQ ID NO: 967691 - DNA, 25 bp, Mus musculus
tttccagctacagtggcagttctca

SEQ ID NO: 967692 - DNA, 25 bp, Mus musculus
tttccagctacatattcctttcaag

SEQ ID NO: 967693 - DNA, 25 bp, Mus musculus
tttccagctcacctgttttgtcggg

SEQ ID NO: 967694 - DNA, 25 bp, Mus musculus
tttccagctcacgtgttttgtcggg

SEQ ID NO: 967695 - DNA, 25 bp, Mus musculus
tttccagctcagatgctcttctcag

SEQ ID NO: 967696 - DNA, 25 bp, Mus musculus
tttccagctcagttgctcttctcag

SEQ ID NO: 967697 - DNA, 25 bp, Mus musculus
tttccagctcctagtcaccgagaga

SEQ ID NO: 967698 - DNA, 25 bp, Mus musculus
tttccagctccttgtcaccgagaga

SEQ ID NO: 967699 - DNA, 25 bp, Mus musculus
tttccagctctcatcatgtactggg

SEQ ID NO: 967700 - DNA, 25 bp, Mus musculus
tttccagctctcttcatgtactggg

SEQ ID NO: 967701 - DNA, 25 bp, Mus musculus
tttccagctcttcgttgaaaacgta

SEQ ID NO: 967702 - DNA, 25 bp, Mus musculus
tttccagctcttggttgaaaacgta

SEQ ID NO: 967703 - DNA, 25 bp, Mus musculus
tttccagctgtaaaaccaccataga

SEQ ID NO: 967704 - DNA, 25 bp, Mus musculus
tttccagctgtataaccaccataga

SEQ ID NO: 967705 - DNA, 25 bp, Mus musculus
tttccaggaagaattttgtaatgat

SEQ ID NO: 967706 - DNA, 25 bp, Mus musculus
tttccaggaagatttttgtaatgat

SEQ ID NO: 967707 - DNA, 25 bp, Mus musculus
tttccaggacacagcaggcattcgt

SEQ ID NO: 967708 - DNA, 25 bp, Mus musculus
tttccaggacactgcaggcattcgt

SEQ ID NO: 967709 - DNA, 25 bp, Mus musculus
tttccaggacccagagtgatgaggt

SEQ ID NO: 967710 - DNA, 25 bp, Mus musculus
tttccaggaccctgagtgatgaggt

SEQ ID NO: 967711 - DNA, 25 bp, Mus musculus
tttccaggacctcttgtcaacttgt

SEQ ID NO: 967712 - DNA, 25 bp, Mus musculus
tttccaggacctgttgtcaacttgt

SEQ ID NO: 967713 - DNA, 25 bp, Mus musculus
tttccaggacgacaacagcacctca

SEQ ID NO: 967714 - DNA, 25 bp, Mus musculus
tttccaggacgagaacagcacctca

SEQ ID NO: 967715 - DNA, 25 bp, Mus musculus
tttccaggagccacggacagtgcta

SEQ ID NO: 967716 - DNA, 25 bp, Mus musculus
tttccaggagcctcggacagtgcta

SEQ ID NO: 967717 - DNA, 25 bp, Mus musculus
tttccaggagctctcttagcatgta

SEQ ID NO: 967718 - DNA, 25 bp, Mus musculus
tttccaggagctgtcttagcatgta

SEQ ID NO: 967719 - DNA, 25 bp, Mus musculus
tttccaggattaccgaaagctgagc

SEQ ID NO: 967720 - DNA, 25 bp, Mus musculus
tttccaggattagcgaaagctgagc

SEQ ID NO: 967721 - DNA, 25 bp, Mus musculus
tttccaggattccatatgactctga

SEQ ID NO: 967722 - DNA, 25 bp, Mus musculus
tttccaggattcgatatgactctga

SEQ ID NO: 967723 - DNA, 25 bp, Mus musculus
tttccaggcaccatgaagcatcagg

SEQ ID NO: 967724 - DNA, 25 bp, Mus musculus
tttccaggcaccttgaagcatcagg

SEQ ID NO: 967725 - DNA, 25 bp, Mus musculus
tttccaggcacgactgaacctcagt

SEQ ID NO: 967726 - DNA, 25 bp, Mus musculus
tttccaggcacgtctgaacctcagt

SEQ ID NO: 967727 - DNA, 25 bp, Mus musculus
tttccaggcagcatatatcagaagt

SEQ ID NO: 967728 - DNA, 25 bp, Mus musculus
tttccaggcagcttatatcagaagt

SEQ ID NO: 967729 - DNA, 25 bp, Mus musculus
tttccaggccacaaacattccagag

SEQ ID NO: 967730 - DNA, 25 bp, Mus musculus
tttccaggccacaagtatgcttttg

SEQ ID NO: 967731 - DNA, 25 bp, Mus musculus
tttccaggccactaacattccagag

SEQ ID NO: 967732 - DNA, 25 bp, Mus musculus
tttccaggccactagtatgcttttg

SEQ ID NO: 967733 - DNA, 25 bp, Mus musculus
tttccaggccagatataaacaatag

SEQ ID NO: 967734 - DNA, 25 bp, Mus musculus
tttccaggccagttataaacaatag

SEQ ID NO: 967735 - DNA, 25 bp, Mus musculus
tttccaggcgatctggtactctgac

SEQ ID NO: 967736 - DNA, 25 bp, Mus musculus
tttccaggcgatgtggtactctgac

SEQ ID NO: 967737 - DNA, 25 bp, Mus musculus
tttccagggcacagaactgatttca

SEQ ID NO: 967738 - DNA, 25 bp, Mus musculus
tttccagggcactgaactgatttca

SEQ ID NO: 967739 - DNA, 25 bp, Mus musculus
tttccagggtcaatctaaaatagct

SEQ ID NO: 967740 - DNA, 25 bp, Mus musculus
tttccagggtcattctaaaatagct

SEQ ID NO: 967741 - DNA, 25 bp, Mus musculus
tttccaggtcgtcgttcaattccag

SEQ ID NO: 967742 - DNA, 25 bp, Mus musculus
tttccaggtcgtggttcaattccag

SEQ ID NO: 967743 - DNA, 25 bp, Mus musculus
tttccaggtctcatgcttgctaagc

SEQ ID NO: 967744 - DNA, 25 bp, Mus musculus
tttccaggtctcttgcttgctaagc

SEQ ID NO: 967745 - DNA, 25 bp, Mus musculus
tttccaggtggtcaggcctcaaata

SEQ ID NO: 967746 - DNA, 25 bp, Mus musculus
tttccaggtggtgaggcctcaaata

SEQ ID NO: 967747 - DNA, 25 bp, Mus musculus
tttccaggtgttcaggatttagctc

SEQ ID NO: 967748 - DNA, 25 bp, Mus musculus
tttccaggtgttgaggatttagctc

SEQ ID NO: 967749 - DNA, 25 bp, Mus musculus
tttccaggttaacccctgccctgaa

SEQ ID NO: 967750 - DNA, 25 bp, Mus musculus
tttccaggttaactaaaggcgatct

SEQ ID NO: 967751 - DNA, 25 bp, Mus musculus
tttccaggttaagccctgccctgaa

SEQ ID NO: 967752 - DNA, 25 bp, Mus musculus
tttccaggttaagtaaaggcgatct

SEQ ID NO: 967753 - DNA, 25 bp, Mus musculus
tttccaggttagcaatgacctcaat

SEQ ID NO: 967754 - DNA, 25 bp, Mus musculus
tttccaggttaggaatgacctcaat

SEQ ID NO: 967755 - DNA, 25 bp, Mus musculus
tttccaggtttcatgggtagtcaat

SEQ ID NO: 967756 - DNA, 25 bp, Mus musculus
tttccaggtttcttgggtagtcaat

SEQ ID NO: 967757 - DNA, 25 bp, Mus musculus
tttccagtaatcctaatttgcacga

SEQ ID NO: 967758 - DNA, 25 bp, Mus musculus
tttccagtaatcgtaatttgcacga

SEQ ID NO: 967759 - DNA, 25 bp, Mus musculus
tttccagtaatgatcttggcacttg

SEQ ID NO: 967760 - DNA, 25 bp, Mus musculus
tttccagtaatgttcttggcacttg

SEQ ID NO: 967761 - DNA, 25 bp, Mus musculus
tttccagtacatcaaagctcgcagc

SEQ ID NO: 967762 - DNA, 25 bp, Mus musculus
tttccagtacatgaaagctcgcagc

SEQ ID NO: 967763 - DNA, 25 bp, Mus musculus
tttccagtaggacttgagggcacac

SEQ ID NO: 967764 - DNA, 25 bp, Mus musculus
tttccagtaggagttgagggcacac

SEQ ID NO: 967765 - DNA, 25 bp, Mus musculus
tttccagtagtaatgttacctgctt

SEQ ID NO: 967766 - DNA, 25 bp, Mus musculus
tttccagtagtattgttacctgctt

SEQ ID NO: 967767 - DNA, 25 bp, Mus musculus
tttccagtagtcaaggcattcctat

SEQ ID NO: 967768 - DNA, 25 bp, Mus musculus
tttccagtagtctaggcattcctat

SEQ ID NO: 967769 - DNA, 25 bp, Mus musculus
tttccagtatgcatacttgttgagt

SEQ ID NO: 967770 - DNA, 25 bp, Mus musculus
tttccagtatgcttacttgttgagt

SEQ ID NO: 967771 - DNA, 25 bp, Mus musculus
tttccagtcattatcaaacatagct

SEQ ID NO: 967772 - DNA, 25 bp, Mus musculus
tttccagtcattccactcttaaaac

SEQ ID NO: 967773 - DNA, 25 bp, Mus musculus
tttccagtcattgcactcttaaaac

SEQ ID NO: 967774 - DNA, 25 bp, Mus musculus
tttccagtcattttcaaacatagct

SEQ ID NO: 967775 - DNA, 25 bp, Mus musculus
tttccagtccatcgtgagcggatgt

SEQ ID NO: 967776 - DNA, 25 bp, Mus musculus
tttccagtccatggtgagcggatgt

SEQ ID NO: 967777 - DNA, 25 bp, Mus musculus
tttccagtcctgctgttagcgagtc

SEQ ID NO: 967778 - DNA, 25 bp, Mus musculus
tttccagtcctggtgttagcgagtc

SEQ ID NO: 967779 - DNA, 25 bp, Mus musculus
tttccagtccttcgatatttaccct

SEQ ID NO: 967780 - DNA, 25 bp, Mus musculus
tttccagtccttggatatttaccct

SEQ ID NO: 967781 - DNA, 25 bp, Mus musculus
tttccagtcgcaaaaatatctactt

SEQ ID NO: 967782 - DNA, 25 bp, Mus musculus
tttccagtcgcataaatatctactt

SEQ ID NO: 967783 - DNA, 25 bp, Mus musculus
tttccagtcgtaaagcagcacagcc

SEQ ID NO: 967784 - DNA, 25 bp, Mus musculus
tttccagtcgtatagcagcacagcc

SEQ ID NO: 967785 - DNA, 25 bp, Mus musculus
tttccagtcgtgactttactgccga

SEQ ID NO: 967786 - DNA, 25 bp, Mus musculus
tttccagtcgtgtctttactgccga

SEQ ID NO: 967787 - DNA, 25 bp, Mus musculus
tttccagtctccacaggaccctgta

SEQ ID NO: 967788 - DNA, 25 bp, Mus musculus
tttccagtctcctcaggaccctgta

SEQ ID NO: 967789 - DNA, 25 bp, Mus musculus
tttccagtgaatcttccctgagcag

SEQ ID NO: 967790 - DNA, 25 bp, Mus musculus
tttccagtgaatgttccctgagcag

SEQ ID NO: 967791 - DNA, 25 bp, Mus musculus
tttccagtgatccttctgtaagaat

SEQ ID NO: 967792 - DNA, 25 bp, Mus musculus
tttccagtgatcgttctgtaagaat

SEQ ID NO: 967793 - DNA, 25 bp, Mus musculus
tttccagtgcagcatatgccagcat

SEQ ID NO: 967794 - DNA, 25 bp, Mus musculus
tttccagtgcaggatatgccagcat

SEQ ID NO: 967795 - DNA, 25 bp, Mus musculus
tttccagtgcccacagatctgaaaa

SEQ ID NO: 967796 - DNA, 25 bp, Mus musculus
tttccagtgccctcagatctgaaaa

SEQ ID NO: 967797 - DNA, 25 bp, Mus musculus
tttccagtgcttatcattcaaattc

SEQ ID NO: 967798 - DNA, 25 bp, Mus musculus
tttccagtgcttttcattcaaattc

SEQ ID NO: 967799 - DNA, 25 bp, Mus musculus
tttccagtggatagtgggtgcacat

SEQ ID NO: 967800 - DNA, 25 bp, Mus musculus
tttccagtggattgtgggtgcacat

SEQ ID NO: 967801 - DNA, 25 bp, Mus musculus
tttccagtggctactgtgccagcaa

SEQ ID NO: 967802 - DNA, 25 bp, Mus musculus
tttccagtggcttctgtgccagcaa

SEQ ID NO: 967803 - DNA, 25 bp, Mus musculus
tttccagtggtcacaggagatccct

SEQ ID NO: 967804 - DNA, 25 bp, Mus musculus
tttccagtggtctcaggagatccct

SEQ ID NO: 967805 - DNA, 25 bp, Mus musculus
tttccagtggtgcttacccaggagc

SEQ ID NO: 967806 - DNA, 25 bp, Mus musculus
tttccagtggtggttacccaggagc

SEQ ID NO: 967807 - DNA, 25 bp, Mus musculus
tttccagtgtcaatctaaagccagg

SEQ ID NO: 967808 - DNA, 25 bp, Mus musculus
tttccagtgtcattctaaagccagg

SEQ ID NO: 967809 - DNA, 25 bp, Mus musculus
tttccagtgttcatggttgactttg

SEQ ID NO: 967810 - DNA, 25 bp, Mus musculus
tttccagtgttcttggttgactttg

SEQ ID NO: 967811 - DNA, 25 bp, Mus musculus
tttccagttgggatcaaccaatggg

SEQ ID NO: 967812 - DNA, 25 bp, Mus musculus
tttccagttgggttcaaccaatggg

SEQ ID NO: 967813 - DNA, 25 bp, Mus musculus
tttccagtttccattcatcctttgt

SEQ ID NO: 967814 - DNA, 25 bp, Mus musculus
tttccagtttcctttcatcctttgt

SEQ ID NO: 967815 - DNA, 25 bp, Mus musculus
tttccagtttgacgttcgtagaaca

SEQ ID NO: 967816 - DNA, 25 bp, Mus musculus
tttccagtttgaggttcgtagaaca

SEQ ID NO: 967817 - DNA, 25 bp, Mus musculus
tttccataaaccatggaggtcacct

SEQ ID NO: 967818 - DNA, 25 bp, Mus musculus
tttccataaaccttggaggtcacct

SEQ ID NO: 967819 - DNA, 25 bp, Mus musculus
tttccataatttccctacttgttct

SEQ ID NO: 967820 - DNA, 25 bp, Mus musculus
tttccataatttgcctacttgttct

SEQ ID NO: 967821 - DNA, 25 bp, Mus musculus
tttccatacaaaagaacaccaggtg

SEQ ID NO: 967822 - DNA, 25 bp, Mus musculus
tttccatacaaatgaacaccaggtg

SEQ ID NO: 967823 - DNA, 25 bp, Mus musculus
tttccatacaatacacataaccttt

SEQ ID NO: 967824 - DNA, 25 bp, Mus musculus
tttccatacaattcacataaccttt

SEQ ID NO: 967825 - DNA, 25 bp, Mus musculus
tttccatactgaacacactgccttt

SEQ ID NO: 967826 - DNA, 25 bp, Mus musculus
tttccatactgatcacactgccttt

SEQ ID NO: 967827 - DNA, 25 bp, Mus musculus
tttccatacttacctccagacacag

SEQ ID NO: 967828 - DNA, 25 bp, Mus musculus
tttccatacttagctccagacacag

SEQ ID NO: 967829 - DNA, 25 bp, Mus musculus
tttccatagcctcagaagccacaga

SEQ ID NO: 967830 - DNA, 25 bp, Mus musculus
tttccatagcctgagaagccacaga

SEQ ID NO: 967831 - DNA, 25 bp, Mus musculus
tttccatagcgaccaggttgtttct

SEQ ID NO: 967832 - DNA, 25 bp, Mus musculus
tttccatagcgagcaggttgtttct

SEQ ID NO: 967833 - DNA, 25 bp, Mus musculus
tttccatagctgactcacacttgaa

SEQ ID NO: 967834 - DNA, 25 bp, Mus musculus
tttccatagctgtctcacacttgaa

SEQ ID NO: 967835 - DNA, 25 bp, Mus musculus
tttccatatcctagagtcttgaaga

SEQ ID NO: 967836 - DNA, 25 bp, Mus musculus
tttccatatccttgagtcttgaaga

SEQ ID NO: 967837 - DNA, 25 bp, Mus musculus
tttccatatggcatagagtcctcat

SEQ ID NO: 967838 - DNA, 25 bp, Mus musculus
tttccatatggccttttcaaaagac

SEQ ID NO: 967839 - DNA, 25 bp, Mus musculus
tttccatatggcgttttcaaaagac

SEQ ID NO: 967840 - DNA, 25 bp, Mus musculus
tttccatatggcttagagtcctcat

SEQ ID NO: 967841 - DNA, 25 bp, Mus musculus
tttccatatggtatggtctcagatt

SEQ ID NO: 967842 - DNA, 25 bp, Mus musculus
tttccatatggtttggtctcagatt

SEQ ID NO: 967843 - DNA, 25 bp, Mus musculus
tttccatattgtcaggcagtgcttt

SEQ ID NO: 967844 - DNA, 25 bp, Mus musculus
tttccatattgtgaggcagtgcttt

SEQ ID NO: 967845 - DNA, 25 bp, Mus musculus
tttccatatttaagcagtacagttg

SEQ ID NO: 967846 - DNA, 25 bp, Mus musculus
tttccatatttatgcagtacagttg

SEQ ID NO: 967847 - DNA, 25 bp, Mus musculus
tttccatcaagtcctgccagtggca

SEQ ID NO: 967848 - DNA, 25 bp, Mus musculus
tttccatcaagtgctgccagtggca

SEQ ID NO: 967849 - DNA, 25 bp, Mus musculus
tttccatccatgattgagagccctg

SEQ ID NO: 967850 - DNA, 25 bp, Mus musculus
tttccatccatgtttgagagccctg

SEQ ID NO: 967851 - DNA, 25 bp, Mus musculus
tttccatcccaaatcagcacaaatg

SEQ ID NO: 967852 - DNA, 25 bp, Mus musculus
tttccatcccaattcagcacaaatg

SEQ ID NO: 967853 - DNA, 25 bp, Mus musculus
tttccatccctcaagtcaacttttg

SEQ ID NO: 967854 - DNA, 25 bp, Mus musculus
tttccatccctctagtcaacttttg

SEQ ID NO: 967855 - DNA, 25 bp, Mus musculus
tttccatcctgtcgactgaaaaaac

SEQ ID NO: 967856 - DNA, 25 bp, Mus musculus
tttccatcctgtggactgaaaaaac

SEQ ID NO: 967857 - DNA, 25 bp, Mus musculus
tttccatcgcttctgaaagctggtc

SEQ ID NO: 967858 - DNA, 25 bp, Mus musculus
tttccatcgcttgtgaaagctggtc

SEQ ID NO: 967859 - DNA, 25 bp, Mus musculus
tttccatcggctaccccgaggttga

SEQ ID NO: 967860 - DNA, 25 bp, Mus musculus
tttccatcggcttccccgaggttga

SEQ ID NO: 967861 - DNA, 25 bp, Mus musculus
tttccatcgtccctgtgcggagagg

SEQ ID NO: 967862 - DNA, 25 bp, Mus musculus
tttccatcgtccgtgtgcggagagg

SEQ ID NO: 967863 - DNA, 25 bp, Mus musculus
tttccatctatcagtcaatccatct

SEQ ID NO: 967864 - DNA, 25 bp, Mus musculus
tttccatctatctgtcaatccatct

SEQ ID NO: 967865 - DNA, 25 bp, Mus musculus
tttccatctcctcaagtcatctttg

SEQ ID NO: 967866 - DNA, 25 bp, Mus musculus
tttccatctcctgaagtcatctttg

SEQ ID NO: 967867 - DNA, 25 bp, Mus musculus
tttccatctctcagtgcttgttagt

SEQ ID NO: 967868 - DNA, 25 bp, Mus musculus
tttccatctctctgtgcttgttagt

SEQ ID NO: 967869 - DNA, 25 bp, Mus musculus
tttccatctctgacaagaatctact

SEQ ID NO: 967870 - DNA, 25 bp, Mus musculus
tttccatctctgtcaagaatctact

SEQ ID NO: 967871 - DNA, 25 bp, Mus musculus
tttccatctggtagatttattttca

SEQ ID NO: 967872 - DNA, 25 bp, Mus musculus
tttccatctggttgatttattttca

SEQ ID NO: 967873 - DNA, 25 bp, Mus musculus
tttccatctgttctgcttctagaag

SEQ ID NO: 967874 - DNA, 25 bp, Mus musculus
tttccatctgttgtgcttctagaag

SEQ ID NO: 967875 - DNA, 25 bp, Mus musculus
tttccatcttaaaacctgggtcctg

SEQ ID NO: 967876 - DNA, 25 bp, Mus musculus
tttccatcttaatacctgggtcctg

SEQ ID NO: 967877 - DNA, 25 bp, Mus musculus
tttccatcttcacttgtgttcaggg

SEQ ID NO: 967878 - DNA, 25 bp, Mus musculus
tttccatcttcagttgtgttcaggg

SEQ ID NO: 967879 - DNA, 25 bp, Mus musculus
tttccatcttttccagttggctcac

SEQ ID NO: 967880 - DNA, 25 bp, Mus musculus
tttccatcttttgcagttggctcac

SEQ ID NO: 967881 - DNA, 25 bp, Mus musculus
tttccatgacatagaaaaagcagta

SEQ ID NO: 967882 - DNA, 25 bp, Mus musculus
tttccatgacatcttaaatccccac

SEQ ID NO: 967883 - DNA, 25 bp, Mus musculus
tttccatgacatgttaaatccccac

SEQ ID NO: 967884 - DNA, 25 bp, Mus musculus
tttccatgacattgaaaaagcagta

SEQ ID NO: 967885 - DNA, 25 bp, Mus musculus
tttccatgactaccccaagcacata

SEQ ID NO: 967886 - DNA, 25 bp, Mus musculus
tttccatgactagcccaagcacata

SEQ ID NO: 967887 - DNA, 25 bp, Mus musculus
tttccatgactgcatcttactgtac

SEQ ID NO: 967888 - DNA, 25 bp, Mus musculus
tttccatgactggatcttactgtac

SEQ ID NO: 967889 - DNA, 25 bp, Mus musculus
tttccatgagaaaccaagcaactta

SEQ ID NO: 967890 - DNA, 25 bp, Mus musculus
tttccatgagaatccaagcaactta

SEQ ID NO: 967891 - DNA, 25 bp, Mus musculus
tttccatgccagactgatcaccggg

SEQ ID NO: 967892 - DNA, 25 bp, Mus musculus
tttccatgccagtctgatcaccggg

SEQ ID NO: 967893 - DNA, 25 bp, Mus musculus
tttccatgctcccatcacgttgttt

SEQ ID NO: 967894 - DNA, 25 bp, Mus musculus
tttccatgctccgatcacgttgttt

SEQ ID NO: 967895 - DNA, 25 bp, Mus musculus
tttccatgcttcagtttgttgatga

SEQ ID NO: 967896 - DNA, 25 bp, Mus musculus
tttccatgcttctgtttgttgatga

SEQ ID NO: 967897 - DNA, 25 bp, Mus musculus
tttccatgcttgctactgcccagat

SEQ ID NO: 967898 - DNA, 25 bp, Mus musculus
tttccatgcttggtactgcccagat

SEQ ID NO: 967899 - DNA, 25 bp, Mus musculus
tttccatggagcactgacacgtaag

SEQ ID NO: 967900 - DNA, 25 bp, Mus musculus
tttccatggagctctgacacgtaag

SEQ ID NO: 967901 - DNA, 25 bp, Mus musculus
tttccatggcctattgttatatcag

SEQ ID NO: 967902 - DNA, 25 bp, Mus musculus
tttccatggccttttgttatatcag

SEQ ID NO: 967903 - DNA, 25 bp, Mus musculus
tttccatggcttcagtatgataaat

SEQ ID NO: 967904 - DNA, 25 bp, Mus musculus
tttccatggcttgagtatgataaat

SEQ ID NO: 967905 - DNA, 25 bp, Mus musculus
tttccatgggaactgttagtctgat

SEQ ID NO: 967906 - DNA, 25 bp, Mus musculus
tttccatgggaagtgttagtctgat

SEQ ID NO: 967907 - DNA, 25 bp, Mus musculus
tttccatggtacagtccaggctgag

SEQ ID NO: 967908 - DNA, 25 bp, Mus musculus
tttccatggtactgtccaggctgag

SEQ ID NO: 967909 - DNA, 25 bp, Mus musculus
tttccatggtgacgagccacttgcc

SEQ ID NO: 967910 - DNA, 25 bp, Mus musculus
tttccatggtgaggagccacttgcc

SEQ ID NO: 967911 - DNA, 25 bp, Mus musculus
tttccatgtagcagacccttcctaa

SEQ ID NO: 967912 - DNA, 25 bp, Mus musculus
tttccatgtagctgacccttcctaa

SEQ ID NO: 967913 - DNA, 25 bp, Mus musculus
tttccatgtaggacaggcttggtat

SEQ ID NO: 967914 - DNA, 25 bp, Mus musculus
tttccatgtaggtcaggcttggtat

SEQ ID NO: 967915 - DNA, 25 bp, Mus musculus
tttccatgtataaaccggcctctgt

SEQ ID NO: 967916 - DNA, 25 bp, Mus musculus
tttccatgtatataccggcctctgt

SEQ ID NO: 967917 - DNA, 25 bp, Mus musculus
tttccatgtcctacatgagcgagtt

SEQ ID NO: 967918 - DNA, 25 bp, Mus musculus
tttccatgtccttcatgagcgagtt

SEQ ID NO: 967919 - DNA, 25 bp, Mus musculus
tttccatgtcttactggcaaccaca

SEQ ID NO: 967920 - DNA, 25 bp, Mus musculus
tttccatgtctttctggcaaccaca

SEQ ID NO: 967921 - DNA, 25 bp, Mus musculus
tttccatgtggcaggatgatccact

SEQ ID NO: 967922 - DNA, 25 bp, Mus musculus
tttccatgtggctggatgatccact

SEQ ID NO: 967923 - DNA, 25 bp, Mus musculus
tttccattactgagagggttcccca

SEQ ID NO: 967924 - DNA, 25 bp, Mus musculus
tttccattactgtgagggttcccca

SEQ ID NO: 967925 - DNA, 25 bp, Mus musculus
tttccattatgcatccctttggtaa

SEQ ID NO: 967926 - DNA, 25 bp, Mus musculus
tttccattatgcttccctttggtaa

SEQ ID NO: 967927 - DNA, 25 bp, Mus musculus
tttccattcagccatgtgaaaagga

SEQ ID NO: 967928 - DNA, 25 bp, Mus musculus
tttccattcagcgatgtgaaaagga

SEQ ID NO: 967929 - DNA, 25 bp, Mus musculus
tttccattccacatcttccattgtt

SEQ ID NO: 967930 - DNA, 25 bp, Mus musculus
tttccattccacttcttccattgtt

SEQ ID NO: 967931 - DNA, 25 bp, Mus musculus
tttccattccatctcttcgaaactt

SEQ ID NO: 967932 - DNA, 25 bp, Mus musculus
tttccattccatgtcttcgaaactt

SEQ ID NO: 967933 - DNA, 25 bp, Mus musculus
tttccattcgagcatcagacaaacg

SEQ ID NO: 967934 - DNA, 25 bp, Mus musculus
tttccattcgaggatcagacaaacg

SEQ ID NO: 967935 - DNA, 25 bp, Mus musculus
tttccattcgctcgcacaagacaag

SEQ ID NO: 967936 - DNA, 25 bp, Mus musculus
tttccattcgctggcacaagacaag

SEQ ID NO: 967937 - DNA, 25 bp, Mus musculus
tttccattctctaaacctcctttga

SEQ ID NO: 967938 - DNA, 25 bp, Mus musculus
tttccattctcttaacctcctttga

SEQ ID NO: 967939 - DNA, 25 bp, Mus musculus
tttccattcttaagtctgacagccc

SEQ ID NO: 967940 - DNA, 25 bp, Mus musculus
tttccattcttatgtctgacagccc

SEQ ID NO: 967941 - DNA, 25 bp, Mus musculus
tttccattgatcatcacggttccat

SEQ ID NO: 967942 - DNA, 25 bp, Mus musculus
tttccattgatcttcacggttccat

SEQ ID NO: 967943 - DNA, 25 bp, Mus musculus
tttccattgcacaaggccaggacag

SEQ ID NO: 967944 - DNA, 25 bp, Mus musculus
tttccattgcactaggccaggacag

SEQ ID NO: 967945 - DNA, 25 bp, Mus musculus
tttccattgcttaccagcatttcag

SEQ ID NO: 967946 - DNA, 25 bp, Mus musculus
tttccattgcttctgctctaggtat

SEQ ID NO: 967947 - DNA, 25 bp, Mus musculus
tttccattgcttgtgctctaggtat

SEQ ID NO: 967948 - DNA, 25 bp, Mus musculus
tttccattgctttccagcatttcag

SEQ ID NO: 967949 - DNA, 25 bp, Mus musculus
tttccatttacactgaataatacac

SEQ ID NO: 967950 - DNA, 25 bp, Mus musculus
tttccatttacagtgaataatacac

SEQ ID NO: 967951 - DNA, 25 bp, Mus musculus
tttccatttcttacccaactgggag

SEQ ID NO: 967952 - DNA, 25 bp, Mus musculus
tttccatttctttcccaactgggag

SEQ ID NO: 967953 - DNA, 25 bp, Mus musculus
tttccatttgctatgctgggagaga

SEQ ID NO: 967954 - DNA, 25 bp, Mus musculus
tttccatttgctcccccgtgtgttt

SEQ ID NO: 967955 - DNA, 25 bp, Mus musculus
tttccatttgctgccccgtgtgttt

SEQ ID NO: 967956 - DNA, 25 bp, Mus musculus
tttccatttgctttgctgggagaga

SEQ ID NO: 967957 - DNA, 25 bp, Mus musculus
tttccatttggaagtgagcaggcgc

SEQ ID NO: 967958 - DNA, 25 bp, Mus musculus
tttccatttggatgtgagcaggcgc

SEQ ID NO: 967959 - DNA, 25 bp, Mus musculus
tttccattttctaagtgtactggga

SEQ ID NO: 967960 - DNA, 25 bp, Mus musculus
tttccattttctcagcagagctctt

SEQ ID NO: 967961 - DNA, 25 bp, Mus musculus
tttccattttctgagcagagctctt

SEQ ID NO: 967962 - DNA, 25 bp, Mus musculus
tttccattttcttagtgtactggga

SEQ ID NO: 967963 - DNA, 25 bp, Mus musculus
tttccatttttcatgccttatttga

SEQ ID NO: 967964 - DNA, 25 bp, Mus musculus
tttccatttttcttgccttatttga

SEQ ID NO: 967965 - DNA, 25 bp, Mus musculus
tttcccaaaacacccacgctatttt

SEQ ID NO: 967966 - DNA, 25 bp, Mus musculus
tttcccaaaacagccacgctatttt

SEQ ID NO: 967967 - DNA, 25 bp, Mus musculus
tttcccaaaattacctgagagacca

SEQ ID NO: 967968 - DNA, 25 bp, Mus musculus
tttcccaaaatttcctgagagacca

SEQ ID NO: 967969 - DNA, 25 bp, Mus musculus
tttcccaaaccaactgcctggaatg

SEQ ID NO: 967970 - DNA, 25 bp, Mus musculus
tttcccaaaccaagagttcaagact

SEQ ID NO: 967971 - DNA, 25 bp, Mus musculus
tttcccaaaccatctgcctggaatg

SEQ ID NO: 967972 - DNA, 25 bp, Mus musculus
tttcccaaaccatgagttcaagact

SEQ ID NO: 967973 - DNA, 25 bp, Mus musculus
tttcccaaatctcgactgcagctgt

SEQ ID NO: 967974 - DNA, 25 bp, Mus musculus
tttcccaaatctggactgcagctgt

SEQ ID NO: 967975 - DNA, 25 bp, Mus musculus
tttcccaaattcatctaaaatgcct

SEQ ID NO: 967976 - DNA, 25 bp, Mus musculus
tttcccaaattcttctaaaatgcct

SEQ ID NO: 967977 - DNA, 25 bp, Mus musculus
tttcccaacaagacttttcagcctt

SEQ ID NO: 967978 - DNA, 25 bp, Mus musculus
tttcccaacaagtcttttcagcctt

SEQ ID NO: 967979 - DNA, 25 bp, Mus musculus
tttcccaaccacatagaaatgcaaa

SEQ ID NO: 967980 - DNA, 25 bp, Mus musculus
tttcccaaccacttagaaatgcaaa

SEQ ID NO: 967981 - DNA, 25 bp, Mus musculus
tttcccaacccactgtggaagggag

SEQ ID NO: 967982 - DNA, 25 bp, Mus musculus
tttcccaacccagtgtggaagggag

SEQ ID NO: 967983 - DNA, 25 bp, Mus musculus
tttcccaaccgtcaactcagctgag

SEQ ID NO: 967984 - DNA, 25 bp, Mus musculus
tttcccaaccgtgaactcagctgag

SEQ ID NO: 967985 - DNA, 25 bp, Mus musculus
tttcccaactttcaaactgcctgct

SEQ ID NO: 967986 - DNA, 25 bp, Mus musculus
tttcccaactttgaaactgcctgct

SEQ ID NO: 967987 - DNA, 25 bp, Mus musculus
tttcccaagagacctattgtgtatt

SEQ ID NO: 967988 - DNA, 25 bp, Mus musculus
tttcccaagagagctattgtgtatt

SEQ ID NO: 967989 - DNA, 25 bp, Mus musculus
tttcccaagctcacagttgacctag

SEQ ID NO: 967990 - DNA, 25 bp, Mus musculus
tttcccaagctctcagttgacctag

SEQ ID NO: 967991 - DNA, 25 bp, Mus musculus
tttcccaaggatagagagcccgctg

SEQ ID NO: 967992 - DNA, 25 bp, Mus musculus
tttcccaaggattgagagcccgctg

SEQ ID NO: 967993 - DNA, 25 bp, Mus musculus
tttcccaagggcacgattttggcaa

SEQ ID NO: 967994 - DNA, 25 bp, Mus musculus
tttcccaagggccacggcattacaa

SEQ ID NO: 967995 - DNA, 25 bp, Mus musculus
tttcccaagggcgacggcattacaa

SEQ ID NO: 967996 - DNA, 25 bp, Mus musculus
tttcccaagggctcgattttggcaa

SEQ ID NO: 967997 - DNA, 25 bp, Mus musculus
tttcccaagtgacgatgctcctgag

SEQ ID NO: 967998 - DNA, 25 bp, Mus musculus
tttcccaagtgaggatgctcctgag

SEQ ID NO: 967999 - DNA, 25 bp, Mus musculus
tttcccaatagcacactcatgatcg

SEQ ID NO: 968000 - DNA, 25 bp, Mus musculus
tttcccaatagctcactcatgatcg

SEQ ID NO: 968001 - DNA, 25 bp, Mus musculus
tttcccaatattctctgagcctgga

SEQ ID NO: 968002 - DNA, 25 bp, Mus musculus
tttcccaatattgtctgagcctgga

SEQ ID NO: 968003 - DNA, 25 bp, Mus musculus
tttcccacaaaccaccatctatttt

SEQ ID NO: 968004 - DNA, 25 bp, Mus musculus
tttcccacaaacgaccatctatttt

SEQ ID NO: 968005 - DNA, 25 bp, Mus musculus
tttcccacactgagctcaggaatga

SEQ ID NO: 968006 - DNA, 25 bp, Mus musculus
tttcccacactgtgctcaggaatga

SEQ ID NO: 968007 - DNA, 25 bp, Mus musculus
tttcccacagaacagagatgcattt

SEQ ID NO: 968008 - DNA, 25 bp, Mus musculus
tttcccacagaagagagatgcattt

SEQ ID NO: 968009 - DNA, 25 bp, Mus musculus
tttcccacagcgaatgaagcatcca

SEQ ID NO: 968010 - DNA, 25 bp, Mus musculus
tttcccacagcgtatgaagcatcca

SEQ ID NO: 968011 - DNA, 25 bp, Mus musculus
tttcccacaggtacgaacctcagat

SEQ ID NO: 968012 - DNA, 25 bp, Mus musculus
tttcccacaggttcgaacctcagat

SEQ ID NO: 968013 - DNA, 25 bp, Mus musculus
tttcccacattactacatctgttaa

SEQ ID NO: 968014 - DNA, 25 bp, Mus musculus
tttcccacattagtacatctgttaa

SEQ ID NO: 968015 - DNA, 25 bp, Mus musculus
tttcccaccaaacgcttggagtata

SEQ ID NO: 968016 - DNA, 25 bp, Mus musculus
tttcccaccaaaggcttggagtata

SEQ ID NO: 968017 - DNA, 25 bp, Mus musculus
tttcccacccctagtaaggcaggag

SEQ ID NO: 968018 - DNA, 25 bp, Mus musculus
tttcccaccccttgtaaggcaggag

SEQ ID NO: 968019 - DNA, 25 bp, Mus musculus
tttcccacccggacagattaaactg

SEQ ID NO: 968020 - DNA, 25 bp, Mus musculus
tttcccacccggtcagattaaactg

SEQ ID NO: 968021 - DNA, 25 bp, Mus musculus
tttcccacctgaagcaagggagact

SEQ ID NO: 968022 - DNA, 25 bp, Mus musculus
tttcccacctgatgcaagggagact

SEQ ID NO: 968023 - DNA, 25 bp, Mus musculus
tttcccacctggagtgcaagctgaa

SEQ ID NO: 968024 - DNA, 25 bp, Mus musculus
tttcccacctggtgtgcaagctgaa

SEQ ID NO: 968025 - DNA, 25 bp, Mus musculus
tttcccacggttcaagagcggatgt

SEQ ID NO: 968026 - DNA, 25 bp, Mus musculus
tttcccacggttgaagagcggatgt

SEQ ID NO: 968027 - DNA, 25 bp, Mus musculus
tttcccactaccaattgcgacaagg

SEQ ID NO: 968028 - DNA, 25 bp, Mus musculus
tttcccactacctattgcgacaagg

SEQ ID NO: 968029 - DNA, 25 bp, Mus musculus
tttcccactactattcatagggaag

SEQ ID NO: 968030 - DNA, 25 bp, Mus musculus
tttcccactacttttcatagggaag

SEQ ID NO: 968031 - DNA, 25 bp, Mus musculus
tttcccactcaacaaatcagggcgt

SEQ ID NO: 968032 - DNA, 25 bp, Mus musculus
tttcccactcaagaaatcagggcgt

SEQ ID NO: 968033 - DNA, 25 bp, Mus musculus
tttcccactgaccaagttactgtag

SEQ ID NO: 968034 - DNA, 25 bp, Mus musculus
tttcccactgacgaagttactgtag

SEQ ID NO: 968035 - DNA, 25 bp, Mus musculus
tttcccactggaatatgattctttg

SEQ ID NO: 968036 - DNA, 25 bp, Mus musculus
tttcccactggattatgattctttg

SEQ ID NO: 968037 - DNA, 25 bp, Mus musculus
tttcccactggcaaatgctttgtaa

SEQ ID NO: 968038 - DNA, 25 bp, Mus musculus
tttcccactggctaatgctttgtaa

SEQ ID NO: 968039 - DNA, 25 bp, Mus musculus
tttcccactgtgcatttcgctttcc

SEQ ID NO: 968040 - DNA, 25 bp, Mus musculus
tttcccactgtggatttcgctttcc

SEQ ID NO: 968041 - DNA, 25 bp, Mus musculus
tttcccactgttatgatgtaaccgc

SEQ ID NO: 968042 - DNA, 25 bp, Mus musculus
tttcccactgttttgatgtaaccgc

SEQ ID NO: 968043 - DNA, 25 bp, Mus musculus
tttcccacttagaaggacgccggcg

SEQ ID NO: 968044 - DNA, 25 bp, Mus musculus
tttcccacttagtaggacgccggcg

SEQ ID NO: 968045 - DNA, 25 bp, Mus musculus
tttcccacttgcaaatcattctgtt

SEQ ID NO: 968046 - DNA, 25 bp, Mus musculus
tttcccacttgctaatcattctgtt

SEQ ID NO: 968047 - DNA, 25 bp, Mus musculus
tttcccagaaatagccgttttgtga

SEQ ID NO: 968048 - DNA, 25 bp, Mus musculus
tttcccagaaattgccgttttgtga

SEQ ID NO: 968049 - DNA, 25 bp, Mus musculus
tttcccagaacccaagccaggtggc

SEQ ID NO: 968050 - DNA, 25 bp, Mus musculus
tttcccagaaccgaagccaggtggc

SEQ ID NO: 968051 - DNA, 25 bp, Mus musculus
tttcccagaataaccgagccacgag

SEQ ID NO: 968052 - DNA, 25 bp, Mus musculus
tttcccagaatactacagctcttgc

SEQ ID NO: 968053 - DNA, 25 bp, Mus musculus
tttcccagaatagtacagctcttgc

SEQ ID NO: 968054 - DNA, 25 bp, Mus musculus
tttcccagaatatccgagccacgag

SEQ ID NO: 968055 - DNA, 25 bp, Mus musculus
tttcccagaatcatcctgaggactt

SEQ ID NO: 968056 - DNA, 25 bp, Mus musculus
tttcccagaatcttcctgaggactt

SEQ ID NO: 968057 - DNA, 25 bp, Mus musculus
tttcccagaattaggtagtgagtgt

SEQ ID NO: 968058 - DNA, 25 bp, Mus musculus
tttcccagaattcccaaatgagaag

SEQ ID NO: 968059 - DNA, 25 bp, Mus musculus
tttcccagaattgccaaatgagaag

SEQ ID NO: 968060 - DNA, 25 bp, Mus musculus
tttcccagaatttggtagtgagtgt

SEQ ID NO: 968061 - DNA, 25 bp, Mus musculus
tttcccagacagcttctaggcagaa

SEQ ID NO: 968062 - DNA, 25 bp, Mus musculus
tttcccagacaggttctaggcagaa

SEQ ID NO: 968063 - DNA, 25 bp, Mus musculus
tttcccagacgtcccctttatttgt

SEQ ID NO: 968064 - DNA, 25 bp, Mus musculus
tttcccagacgtgccctttatttgt

SEQ ID NO: 968065 - DNA, 25 bp, Mus musculus
tttcccagagaacagttaaagaaca

SEQ ID NO: 968066 - DNA, 25 bp, Mus musculus
tttcccagagaagagttaaagaaca

SEQ ID NO: 968067 - DNA, 25 bp, Mus musculus
tttcccagagagaccacagggctgc

SEQ ID NO: 968068 - DNA, 25 bp, Mus musculus
tttcccagagagtccacagggctgc

SEQ ID NO: 968069 - DNA, 25 bp, Mus musculus
tttcccagatctctgcaaaagcagt

SEQ ID NO: 968070 - DNA, 25 bp, Mus musculus
tttcccagatctgtgcaaaagcagt

SEQ ID NO: 968071 - DNA, 25 bp, Mus musculus
tttcccagatgacagttcctgcctc

SEQ ID NO: 968072 - DNA, 25 bp, Mus musculus
tttcccagatgagagttcctgcctc

SEQ ID NO: 968073 - DNA, 25 bp, Mus musculus
tttcccagattcacagagacttttc

SEQ ID NO: 968074 - DNA, 25 bp, Mus musculus
tttcccagattctcagagacttttc

SEQ ID NO: 968075 - DNA, 25 bp, Mus musculus
tttcccagcatgagattgtttattc

SEQ ID NO: 968076 - DNA, 25 bp, Mus musculus
tttcccagcatgtgattgtttattc

SEQ ID NO: 968077 - DNA, 25 bp, Mus musculus
tttcccagcattataatctacaaat

SEQ ID NO: 968078 - DNA, 25 bp, Mus musculus
tttcccagcattttaatctacaaat

SEQ ID NO: 968079 - DNA, 25 bp, Mus musculus
tttcccagctaacagggtgttcgct

SEQ ID NO: 968080 - DNA, 25 bp, Mus musculus
tttcccagctaagagggtgttcgct

SEQ ID NO: 968081 - DNA, 25 bp, Mus musculus
tttcccagctagctatgtgcatggc

SEQ ID NO: 968082 - DNA, 25 bp, Mus musculus
tttcccagctaggtatgtgcatggc

SEQ ID NO: 968083 - DNA, 25 bp, Mus musculus
tttcccagctttaatcgacagaagg

SEQ ID NO: 968084 - DNA, 25 bp, Mus musculus
tttcccagcttttatcgacagaagg

SEQ ID NO: 968085 - DNA, 25 bp, Mus musculus
tttcccaggaagcatagtactacag

SEQ ID NO: 968086 - DNA, 25 bp, Mus musculus
tttcccaggaaggatagtactacag

SEQ ID NO: 968087 - DNA, 25 bp, Mus musculus
tttcccaggcaaagatagtcccaaa

SEQ ID NO: 968088 - DNA, 25 bp, Mus musculus
tttcccaggcaacgctttcgttcaa

SEQ ID NO: 968089 - DNA, 25 bp, Mus musculus
tttcccaggcaaggctttcgttcaa

SEQ ID NO: 968090 - DNA, 25 bp, Mus musculus
tttcccaggcaatgatagtcccaaa

SEQ ID NO: 968091 - DNA, 25 bp, Mus musculus
tttcccaggcagacttgggacttac

SEQ ID NO: 968092 - DNA, 25 bp, Mus musculus
tttcccaggcagtcttgggacttac

SEQ ID NO: 968093 - DNA, 25 bp, Mus musculus
tttcccagggaccagtgcaggcaca

SEQ ID NO: 968094 - DNA, 25 bp, Mus musculus
tttcccagggaccattagtgtcttt

SEQ ID NO: 968095 - DNA, 25 bp, Mus musculus
tttcccagggacgagtgcaggcaca

SEQ ID NO: 968096 - DNA, 25 bp, Mus musculus
tttcccagggacgattagtgtcttt

SEQ ID NO: 968097 - DNA, 25 bp, Mus musculus
tttcccagggtaactgtggttgcct

SEQ ID NO: 968098 - DNA, 25 bp, Mus musculus
tttcccagggtacatagccatcaaa

SEQ ID NO: 968099 - DNA, 25 bp, Mus musculus
tttcccagggtagatagccatcaaa

SEQ ID NO: 968100 - DNA, 25 bp, Mus musculus
tttcccagggtatctgtggttgcct

SEQ ID NO: 968101 - DNA, 25 bp, Mus musculus
tttcccaggtccaccagtgtgcttt

SEQ ID NO: 968102 - DNA, 25 bp, Mus musculus
tttcccaggtcctccagtgtgcttt

SEQ ID NO: 968103 - DNA, 25 bp, Mus musculus
tttcccaggtgaacgagtgtttaat

SEQ ID NO: 968104 - DNA, 25 bp, Mus musculus
tttcccaggtgatcgagtgtttaat

SEQ ID NO: 968105 - DNA, 25 bp, Mus musculus
tttcccagtaccaatcccaagggct

SEQ ID NO: 968106 - DNA, 25 bp, Mus musculus
tttcccagtacctatcccaagggct

SEQ ID NO: 968107 - DNA, 25 bp, Mus musculus
tttcccagtagaaggtatgctccaa

SEQ ID NO: 968108 - DNA, 25 bp, Mus musculus
tttcccagtagatggtatgctccaa

SEQ ID NO: 968109 - DNA, 25 bp, Mus musculus
tttcccagtatgagcttcctgcgaa

SEQ ID NO: 968110 - DNA, 25 bp, Mus musculus
tttcccagtatgtgcttcctgcgaa

SEQ ID NO: 968111 - DNA, 25 bp, Mus musculus
tttcccagtcatcgtgtgtgtgtct

SEQ ID NO: 968112 - DNA, 25 bp, Mus musculus
tttcccagtcatggtgtgtgtgtct

SEQ ID NO: 968113 - DNA, 25 bp, Mus musculus
tttcccagtccgaactctgctgtga

SEQ ID NO: 968114 - DNA, 25 bp, Mus musculus
tttcccagtccgtactctgctgtga

SEQ ID NO: 968115 - DNA, 25 bp, Mus musculus
tttcccagtcgccaagagaggacgg

SEQ ID NO: 968116 - DNA, 25 bp, Mus musculus
tttcccagtcgcgaagagaggacgg

SEQ ID NO: 968117 - DNA, 25 bp, Mus musculus
tttcccagtttcacaaccactcata

SEQ ID NO: 968118 - DNA, 25 bp, Mus musculus
tttcccagtttctcaaccactcata

SEQ ID NO: 968119 - DNA, 25 bp, Mus musculus
tttcccataaatactcagctttccg

SEQ ID NO: 968120 - DNA, 25 bp, Mus musculus
tttcccataaattctcagctttccg

SEQ ID NO: 968121 - DNA, 25 bp, Mus musculus
tttcccataattaactcatccatag

SEQ ID NO: 968122 - DNA, 25 bp, Mus musculus
tttcccataatttactcatccatag

SEQ ID NO: 968123 - DNA, 25 bp, Mus musculus
tttcccatacctatgacgttcagat

SEQ ID NO: 968124 - DNA, 25 bp, Mus musculus
tttcccatacctttgacgttcagat

SEQ ID NO: 968125 - DNA, 25 bp, Mus musculus
tttcccatagtcaggttgtggatga

SEQ ID NO: 968126 - DNA, 25 bp, Mus musculus
tttcccatagtctggttgtggatga

SEQ ID NO: 968127 - DNA, 25 bp, Mus musculus
tttcccatatcactgcataacactg

SEQ ID NO: 968128 - DNA, 25 bp, Mus musculus
tttcccatatcagtgcataacactg

SEQ ID NO: 968129 - DNA, 25 bp, Mus musculus
tttcccatattcatccttagactca

SEQ ID NO: 968130 - DNA, 25 bp, Mus musculus
tttcccatattcttccttagactca

SEQ ID NO: 968131 - DNA, 25 bp, Mus musculus
tttcccatatttagtgttctgtctg

SEQ ID NO: 968132 - DNA, 25 bp, Mus musculus
tttcccatattttgtgttctgtctg

SEQ ID NO: 968133 - DNA, 25 bp, Mus musculus
tttcccatcacaatgacactttatt

SEQ ID NO: 968134 - DNA, 25 bp, Mus musculus
tttcccatcacacaggacagagaac

SEQ ID NO: 968135 - DNA, 25 bp, Mus musculus
tttcccatcacagaggacagagaac

SEQ ID NO: 968136 - DNA, 25 bp, Mus musculus
tttcccatcacattgacactttatt

SEQ ID NO: 968137 - DNA, 25 bp, Mus musculus
tttcccatcagcaggtactgctaag

SEQ ID NO: 968138 - DNA, 25 bp, Mus musculus
tttcccatcagctggtactgctaag

SEQ ID NO: 968139 - DNA, 25 bp, Mus musculus
tttcccatcataagattcctggtcc

SEQ ID NO: 968140 - DNA, 25 bp, Mus musculus
tttcccatcatatgattcctggtcc

SEQ ID NO: 968141 - DNA, 25 bp, Mus musculus
tttcccatcgacaccgtaatctgat

SEQ ID NO: 968142 - DNA, 25 bp, Mus musculus
tttcccatcgactccgtaatctgat

SEQ ID NO: 968143 - DNA, 25 bp, Mus musculus
tttcccatctaccaggttgagcatc

SEQ ID NO: 968144 - DNA, 25 bp, Mus musculus
tttcccatctacgaggttgagcatc

SEQ ID NO: 968145 - DNA, 25 bp, Mus musculus
tttcccatctgtaaaccttgttttg

SEQ ID NO: 968146 - DNA, 25 bp, Mus musculus
tttcccatctgtacaagctccatgt

SEQ ID NO: 968147 - DNA, 25 bp, Mus musculus
tttcccatctgttaaccttgttttg

SEQ ID NO: 968148 - DNA, 25 bp, Mus musculus
tttcccatctgttcaagctccatgt

SEQ ID NO: 968149 - DNA, 25 bp, Mus musculus
tttcccatcttaactagcacatact

SEQ ID NO: 968150 - DNA, 25 bp, Mus musculus
tttcccatcttatctagcacatact

SEQ ID NO: 968151 - DNA, 25 bp, Mus musculus
tttcccatcttcagactaaggaagc

SEQ ID NO: 968152 - DNA, 25 bp, Mus musculus
tttcccatcttctgactaaggaagc

SEQ ID NO: 968153 - DNA, 25 bp, Mus musculus
tttcccatgctccagcctagtggtg

SEQ ID NO: 968154 - DNA, 25 bp, Mus musculus
tttcccatgctcgagcctagtggtg

SEQ ID NO: 968155 - DNA, 25 bp, Mus musculus
tttcccatggacactgtgcatcatg

SEQ ID NO: 968156 - DNA, 25 bp, Mus musculus
tttcccatggacagttggccatgtc

SEQ ID NO: 968157 - DNA, 25 bp, Mus musculus
tttcccatggactctgtgcatcatg

SEQ ID NO: 968158 - DNA, 25 bp, Mus musculus
tttcccatggactgttggccatgtc

SEQ ID NO: 968159 - DNA, 25 bp, Mus musculus
tttcccatggagactgttctgtagt

SEQ ID NO: 968160 - DNA, 25 bp, Mus musculus
tttcccatggagtctgttctgtagt

SEQ ID NO: 968161 - DNA, 25 bp, Mus musculus
tttcccatgggtcacaggctctaca

SEQ ID NO: 968162 - DNA, 25 bp, Mus musculus
tttcccatgggtgacaggctctaca

SEQ ID NO: 968163 - DNA, 25 bp, Mus musculus
tttcccatgtgcacggtgttcagtg

SEQ ID NO: 968164 - DNA, 25 bp, Mus musculus
tttcccatgtgctcggtgttcagtg

SEQ ID NO: 968165 - DNA, 25 bp, Mus musculus
tttcccatgtggctagttactggta

SEQ ID NO: 968166 - DNA, 25 bp, Mus musculus
tttcccatgtgggtagttactggta

SEQ ID NO: 968167 - DNA, 25 bp, Mus musculus
tttcccatgtttccctcaaccagag

SEQ ID NO: 968168 - DNA, 25 bp, Mus musculus
tttcccatgtttgcctcaaccagag

SEQ ID NO: 968169 - DNA, 25 bp, Mus musculus
tttcccattaggagtttgcgtgtgt

SEQ ID NO: 968170 - DNA, 25 bp, Mus musculus
tttcccattaggtgtttgcgtgtgt

SEQ ID NO: 968171 - DNA, 25 bp, Mus musculus
tttcccattcctaaatcatttatta

SEQ ID NO: 968172 - DNA, 25 bp, Mus musculus
tttcccattccttaatcatttatta

SEQ ID NO: 968173 - DNA, 25 bp, Mus musculus
tttcccattctaagactttgctgat

SEQ ID NO: 968174 - DNA, 25 bp, Mus musculus
tttcccattctatgactttgctgat

SEQ ID NO: 968175 - DNA, 25 bp, Mus musculus
tttcccattgagattcagtctgtat

SEQ ID NO: 968176 - DNA, 25 bp, Mus musculus
tttcccattgagtttcagtctgtat

SEQ ID NO: 968177 - DNA, 25 bp, Mus musculus
tttcccattggtcctgggagcccag

SEQ ID NO: 968178 - DNA, 25 bp, Mus musculus
tttcccattggtgctgggagcccag

SEQ ID NO: 968179 - DNA, 25 bp, Mus musculus
tttcccattgtaaccatgtgaccgt

SEQ ID NO: 968180 - DNA, 25 bp, Mus musculus
tttcccattgtatccatgtgaccgt

SEQ ID NO: 968181 - DNA, 25 bp, Mus musculus
tttcccatttctcaaatatttggta

SEQ ID NO: 968182 - DNA, 25 bp, Mus musculus
tttcccatttctgaaatatttggta

SEQ ID NO: 968183 - DNA, 25 bp, Mus musculus
tttcccattttacactctcagttga

SEQ ID NO: 968184 - DNA, 25 bp, Mus musculus
tttcccattttagactctcagttga

SEQ ID NO: 968185 - DNA, 25 bp, Mus musculus
tttccccaaacgatacaattgacag

SEQ ID NO: 968186 - DNA, 25 bp, Mus musculus
tttccccaaacgttacaattgacag

SEQ ID NO: 968187 - DNA, 25 bp, Mus musculus
tttccccaaactcgatctgtgaggc

SEQ ID NO: 968188 - DNA, 25 bp, Mus musculus
tttccccaaactggatctgtgaggc

SEQ ID NO: 968189 - DNA, 25 bp, Mus musculus
tttccccaaagacagcttgttccaa

SEQ ID NO: 968190 - DNA, 25 bp, Mus musculus
tttccccaaagagagcttgttccaa

SEQ ID NO: 968191 - DNA, 25 bp, Mus musculus
tttccccaaataatcctgccacttt

SEQ ID NO: 968192 - DNA, 25 bp, Mus musculus
tttccccaaatattcctgccacttt

SEQ ID NO: 968193 - DNA, 25 bp, Mus musculus
tttccccaaatgcatatggttgctg

SEQ ID NO: 968194 - DNA, 25 bp, Mus musculus
tttccccaaatggatatggttgctg

SEQ ID NO: 968195 - DNA, 25 bp, Mus musculus
tttccccacaacactgcatacgatg

SEQ ID NO: 968196 - DNA, 25 bp, Mus musculus
tttccccacaactctgcatacgatg

SEQ ID NO: 968197 - DNA, 25 bp, Mus musculus
tttccccacaagcacaaccaaatgt

SEQ ID NO: 968198 - DNA, 25 bp, Mus musculus
tttccccacaaggacaaccaaatgt

SEQ ID NO: 968199 - DNA, 25 bp, Mus musculus
tttccccacatcactttgtatggta

SEQ ID NO: 968200 - DNA, 25 bp, Mus musculus
tttccccacatctctttgtatggta

SEQ ID NO: 968201 - DNA, 25 bp, Mus musculus
tttccccacccaaaatgcagattcg

SEQ ID NO: 968202 - DNA, 25 bp, Mus musculus
tttccccacccataatgcagattcg

SEQ ID NO: 968203 - DNA, 25 bp, Mus musculus
tttccccacctaagagaatgacact

SEQ ID NO: 968204 - DNA, 25 bp, Mus musculus
tttccccacctatgagaatgacact

SEQ ID NO: 968205 - DNA, 25 bp, Mus musculus
tttccccaccttactaataatgtct

SEQ ID NO: 968206 - DNA, 25 bp, Mus musculus
tttccccacctttctaataatgtct

SEQ ID NO: 968207 - DNA, 25 bp, Mus musculus
tttccccacttacatcccgtgaggg

SEQ ID NO: 968208 - DNA, 25 bp, Mus musculus
tttccccacttagatcccgtgaggg

SEQ ID NO: 968209 - DNA, 25 bp, Mus musculus
tttccccacttgaggtggttcttat

SEQ ID NO: 968210 - DNA, 25 bp, Mus musculus
tttccccacttgtggtggttcttat

SEQ ID NO: 968211 - DNA, 25 bp, Mus musculus
tttccccagaacatacagtagcctg

SEQ ID NO: 968212 - DNA, 25 bp, Mus musculus
tttccccagaacttacagtagcctg

SEQ ID NO: 968213 - DNA, 25 bp, Mus musculus
tttccccagcatcctactaacagag

SEQ ID NO: 968214 - DNA, 25 bp, Mus musculus
tttccccagcatgctactaacagag

SEQ ID NO: 968215 - DNA, 25 bp, Mus musculus
tttccccagctgactctagtttgtg

SEQ ID NO: 968216 - DNA, 25 bp, Mus musculus
tttccccagctgtctctagtttgtg

SEQ ID NO: 968217 - DNA, 25 bp, Mus musculus
tttccccaggaaccaagtcaaatct

SEQ ID NO: 968218 - DNA, 25 bp, Mus musculus
tttccccaggaacgtgcaggtgtca

SEQ ID NO: 968219 - DNA, 25 bp, Mus musculus
tttccccaggaagcaagtcaaatct

SEQ ID NO: 968220 - DNA, 25 bp, Mus musculus
tttccccaggaaggtgcaggtgtca

SEQ ID NO: 968221 - DNA, 25 bp, Mus musculus
tttccccaggcaaaggtggatgccc

SEQ ID NO: 968222 - DNA, 25 bp, Mus musculus
tttccccaggcataggtggatgccc

SEQ ID NO: 968223 - DNA, 25 bp, Mus musculus
tttccccagggcattcactgtgatt

SEQ ID NO: 968224 - DNA, 25 bp, Mus musculus
tttccccagggctttcactgtgatt

SEQ ID NO: 968225 - DNA, 25 bp, Mus musculus
tttccccaggtcatgttgtggattg

SEQ ID NO: 968226 - DNA, 25 bp, Mus musculus
tttccccaggtcttgttgtggattg

SEQ ID NO: 968227 - DNA, 25 bp, Mus musculus
tttccccagtgtatccggtgagaag

SEQ ID NO: 968228 - DNA, 25 bp, Mus musculus
tttccccagtgtttccggtgagaag

SEQ ID NO: 968229 - DNA, 25 bp, Mus musculus
tttccccagttgcagccagttctaa

SEQ ID NO: 968230 - DNA, 25 bp, Mus musculus
tttccccagttggagccagttctaa

SEQ ID NO: 968231 - DNA, 25 bp, Mus musculus
tttccccataaaaggctcttggcca

SEQ ID NO: 968232 - DNA, 25 bp, Mus musculus
tttccccataaatggctcttggcca

SEQ ID NO: 968233 - DNA, 25 bp, Mus musculus
tttccccatatgattcctgtatttg

SEQ ID NO: 968234 - DNA, 25 bp, Mus musculus
tttccccatatgtttcctgtatttg

SEQ ID NO: 968235 - DNA, 25 bp, Mus musculus
tttccccatcggactgagcctgact

SEQ ID NO: 968236 - DNA, 25 bp, Mus musculus
tttccccatcggtctgagcctgact

SEQ ID NO: 968237 - DNA, 25 bp, Mus musculus
tttccccatgaacaaatgttcacac

SEQ ID NO: 968238 - DNA, 25 bp, Mus musculus
tttccccatgaagaaatgttcacac

SEQ ID NO: 968239 - DNA, 25 bp, Mus musculus
tttccccatgacacactggaatctg

SEQ ID NO: 968240 - DNA, 25 bp, Mus musculus
tttccccatgactcactggaatctg

SEQ ID NO: 968241 - DNA, 25 bp, Mus musculus
tttccccatgtgagcattctacaaa

SEQ ID NO: 968242 - DNA, 25 bp, Mus musculus
tttccccatgtgtgcattctacaaa

SEQ ID NO: 968243 - DNA, 25 bp, Mus musculus
tttccccatgttagttatagcttgc

SEQ ID NO: 968244 - DNA, 25 bp, Mus musculus
tttccccatgttcctgagcattgga

SEQ ID NO: 968245 - DNA, 25 bp, Mus musculus
tttccccatgttgctgagcattgga

SEQ ID NO: 968246 - DNA, 25 bp, Mus musculus
tttccccatgtttgttatagcttgc

SEQ ID NO: 968247 - DNA, 25 bp, Mus musculus
tttccccattcaaatgcacaccaag

SEQ ID NO: 968248 - DNA, 25 bp, Mus musculus
tttccccattcatatgcacaccaag

SEQ ID NO: 968249 - DNA, 25 bp, Mus musculus
tttccccattgtattccagtgcttt

SEQ ID NO: 968250 - DNA, 25 bp, Mus musculus
tttccccattgttttccagtgcttt

SEQ ID NO: 968251 - DNA, 25 bp, Mus musculus
tttccccctggtagaggacagagcc

SEQ ID NO: 968252 - DNA, 25 bp, Mus musculus
tttccccctggttgaggacagagcc

SEQ ID NO: 968253 - DNA, 25 bp, Mus musculus
tttcccccttatattctagttctga

SEQ ID NO: 968254 - DNA, 25 bp, Mus musculus
tttcccccttattttctagttctga

SEQ ID NO: 968255 - DNA, 25 bp, Mus musculus
tttccccgacctctgaagtagctaa

SEQ ID NO: 968256 - DNA, 25 bp, Mus musculus
tttccccgacctgtgaagtagctaa

SEQ ID NO: 968257 - DNA, 25 bp, Mus musculus
tttccccgagaacatattatcagca

SEQ ID NO: 968258 - DNA, 25 bp, Mus musculus
tttccccgagaagatattatcagca

SEQ ID NO: 968259 - DNA, 25 bp, Mus musculus
tttccccggctgaaggagttcattc

SEQ ID NO: 968260 - DNA, 25 bp, Mus musculus
tttccccggctgtaggagttcattc

SEQ ID NO: 968261 - DNA, 25 bp, Mus musculus
tttccccgtaagaagcagtgctagt

SEQ ID NO: 968262 - DNA, 25 bp, Mus musculus
tttccccgtaagtagcagtgctagt

SEQ ID NO: 968263 - DNA, 25 bp, Mus musculus
tttccccgtgtgactagtaagcagt

SEQ ID NO: 968264 - DNA, 25 bp, Mus musculus
tttccccgtgtgtctagtaagcagt

SEQ ID NO: 968265 - DNA, 25 bp, Mus musculus
tttcccctaaacaactggcacagca

SEQ ID NO: 968266 - DNA, 25 bp, Mus musculus
tttcccctaaactactggcacagca

SEQ ID NO: 968267 - DNA, 25 bp, Mus musculus
tttcccctaaccaagttctgatgat

SEQ ID NO: 968268 - DNA, 25 bp, Mus musculus
tttcccctaacccacagagatattc

SEQ ID NO: 968269 - DNA, 25 bp, Mus musculus
tttcccctaaccgacagagatattc

SEQ ID NO: 968270 - DNA, 25 bp, Mus musculus
tttcccctaacctagttctgatgat

SEQ ID NO: 968271 - DNA, 25 bp, Mus musculus
tttcccctaactcagattgaccatc

SEQ ID NO: 968272 - DNA, 25 bp, Mus musculus
tttcccctaactgagattgaccatc

SEQ ID NO: 968273 - DNA, 25 bp, Mus musculus
tttcccctaagtaatttgtcctctg

SEQ ID NO: 968274 - DNA, 25 bp, Mus musculus
tttcccctaagtcgcttttgccaga

SEQ ID NO: 968275 - DNA, 25 bp, Mus musculus
tttcccctaagtggcttttgccaga

SEQ ID NO: 968276 - DNA, 25 bp, Mus musculus
tttcccctaagttatttgtcctctg

SEQ ID NO: 968277 - DNA, 25 bp, Mus musculus
tttcccctaatgatcccatctgtgc

SEQ ID NO: 968278 - DNA, 25 bp, Mus musculus
tttcccctaatgttcccatctgtgc

SEQ ID NO: 968279 - DNA, 25 bp, Mus musculus
tttcccctacacagaccaaatcata

SEQ ID NO: 968280 - DNA, 25 bp, Mus musculus
tttcccctacactgaccaaatcata

SEQ ID NO: 968281 - DNA, 25 bp, Mus musculus
tttcccctaccaaagctttatcaaa

SEQ ID NO: 968282 - DNA, 25 bp, Mus musculus
tttcccctaccatagctttatcaaa

SEQ ID NO: 968283 - DNA, 25 bp, Mus musculus
tttcccctatttcctactccaagag

SEQ ID NO: 968284 - DNA, 25 bp, Mus musculus
tttcccctatttgctactccaagag

SEQ ID NO: 968285 - DNA, 25 bp, Mus musculus
tttcccctcaagcttttgctcatgg

SEQ ID NO: 968286 - DNA, 25 bp, Mus musculus
tttcccctcaaggttttgctcatgg

SEQ ID NO: 968287 - DNA, 25 bp, Mus musculus
tttcccctcagcacttaggagccat

SEQ ID NO: 968288 - DNA, 25 bp, Mus musculus
tttcccctcagctcttaggagccat

SEQ ID NO: 968289 - DNA, 25 bp, Mus musculus
tttcccctcatcatgattgccatga

SEQ ID NO: 968290 - DNA, 25 bp, Mus musculus
tttcccctcatcatgcagtttttgg

SEQ ID NO: 968291 - DNA, 25 bp, Mus musculus
tttcccctcatcttgattgccatga

SEQ ID NO: 968292 - DNA, 25 bp, Mus musculus
tttcccctcatcttgcagtttttgg

SEQ ID NO: 968293 - DNA, 25 bp, Mus musculus
tttcccctccacatctgaggagtgt

SEQ ID NO: 968294 - DNA, 25 bp, Mus musculus
tttcccctccacttctgaggagtgt

SEQ ID NO: 968295 - DNA, 25 bp, Mus musculus
tttcccctccagagactgaactggg

SEQ ID NO: 968296 - DNA, 25 bp, Mus musculus
tttcccctccagatacactgtggaa

SEQ ID NO: 968297 - DNA, 25 bp, Mus musculus
tttcccctccagtgactgaactggg

SEQ ID NO: 968298 - DNA, 25 bp, Mus musculus
tttcccctccagttacactgtggaa

SEQ ID NO: 968299 - DNA, 25 bp, Mus musculus
tttcccctcctcagttatgtagagc

SEQ ID NO: 968300 - DNA, 25 bp, Mus musculus
tttcccctcctctgttatgtagagc

SEQ ID NO: 968301 - DNA, 25 bp, Mus musculus
tttcccctcgtgaaaccacatatta

SEQ ID NO: 968302 - DNA, 25 bp, Mus musculus
tttcccctcgtgtaaccacatatta

SEQ ID NO: 968303 - DNA, 25 bp, Mus musculus
tttcccctctgaacttcatgtgttt

SEQ ID NO: 968304 - DNA, 25 bp, Mus musculus
tttcccctctgatcttcatgtgttt

SEQ ID NO: 968305 - DNA, 25 bp, Mus musculus
tttcccctgaacagcggatccgatg

SEQ ID NO: 968306 - DNA, 25 bp, Mus musculus
tttcccctgaactgcggatccgatg

SEQ ID NO: 968307 - DNA, 25 bp, Mus musculus
tttcccctgaccactaaaatgttat

SEQ ID NO: 968308 - DNA, 25 bp, Mus musculus
tttcccctgacctctaaaatgttat

SEQ ID NO: 968309 - DNA, 25 bp, Mus musculus
tttcccctgagcagcagatctgtaa

SEQ ID NO: 968310 - DNA, 25 bp, Mus musculus
tttcccctgagctgcagatctgtaa

SEQ ID NO: 968311 - DNA, 25 bp, Mus musculus
tttcccctgggaccgttgcatctgg

SEQ ID NO: 968312 - DNA, 25 bp, Mus musculus
tttcccctgggagcgttgcatctgg

SEQ ID NO: 968313 - DNA, 25 bp, Mus musculus
tttcccctggtcatttggtctaaga

SEQ ID NO: 968314 - DNA, 25 bp, Mus musculus
tttcccctggtcttttggtctaaga

SEQ ID NO: 968315 - DNA, 25 bp, Mus musculus
tttcccctggttagatctgactact

SEQ ID NO: 968316 - DNA, 25 bp, Mus musculus
tttcccctggtttgatctgactact

SEQ ID NO: 968317 - DNA, 25 bp, Mus musculus
tttccccttagcatgtttgctaaat

SEQ ID NO: 968318 - DNA, 25 bp, Mus musculus
tttccccttagcttgtttgctaaat

SEQ ID NO: 968319 - DNA, 25 bp, Mus musculus
tttccccttataagtcatgtgcagc

SEQ ID NO: 968320 - DNA, 25 bp, Mus musculus
tttccccttatatgtcatgtgcagc

SEQ ID NO: 968321 - DNA, 25 bp, Mus musculus
tttccccttcacctagtttctggct

SEQ ID NO: 968322 - DNA, 25 bp, Mus musculus
tttccccttcacgtagtttctggct

SEQ ID NO: 968323 - DNA, 25 bp, Mus musculus
tttccccttcgtatcttagagatga

SEQ ID NO: 968324 - DNA, 25 bp, Mus musculus
tttccccttcgtttcttagagatga

SEQ ID NO: 968325 - DNA, 25 bp, Mus musculus
tttccccttctacatgagattcaag

SEQ ID NO: 968326 - DNA, 25 bp, Mus musculus
tttccccttctagatgagattcaag

SEQ ID NO: 968327 - DNA, 25 bp, Mus musculus
tttccccttctcaaaccatgataag

SEQ ID NO: 968328 - DNA, 25 bp, Mus musculus
tttccccttctctaaccatgataag

SEQ ID NO: 968329 - DNA, 25 bp, Mus musculus
tttccccttggaagtgactgcttag

SEQ ID NO: 968330 - DNA, 25 bp, Mus musculus
tttccccttggatgtgactgcttag

SEQ ID NO: 968331 - DNA, 25 bp, Mus musculus
tttccccttgttccattgggcaaag

SEQ ID NO: 968332 - DNA, 25 bp, Mus musculus
tttccccttgttgcattgggcaaag

SEQ ID NO: 968333 - DNA, 25 bp, Mus musculus
tttcccctttagacaaagagcaact

SEQ ID NO: 968334 - DNA, 25 bp, Mus musculus
tttcccctttagtcaaagagcaact

SEQ ID NO: 968335 - DNA, 25 bp, Mus musculus
tttccccttttcatcacaattaatg

SEQ ID NO: 968336 - DNA, 25 bp, Mus musculus
tttccccttttcttcacaattaatg

SEQ ID NO: 968337 - DNA, 25 bp, Mus musculus
tttcccgaacttcaaggtctaggca

SEQ ID NO: 968338 - DNA, 25 bp, Mus musculus
tttcccgaacttgaaggtctaggca

SEQ ID NO: 968339 - DNA, 25 bp, Mus musculus
tttcccgaagcccactgagcgagga

SEQ ID NO: 968340 - DNA, 25 bp, Mus musculus
tttcccgaagccgactgagcgagga

SEQ ID NO: 968341 - DNA, 25 bp, Mus musculus
tttcccgacatgcacaattccaaca

SEQ ID NO: 968342 - DNA, 25 bp, Mus musculus
tttcccgacatggacaattccaaca

SEQ ID NO: 968343 - DNA, 25 bp, Mus musculus
tttcccgacctcattggaggcagaa

SEQ ID NO: 968344 - DNA, 25 bp, Mus musculus
tttcccgacctctttggaggcagaa

SEQ ID NO: 968345 - DNA, 25 bp, Mus musculus
tttcccgactgacagcttggacaga

SEQ ID NO: 968346 - DNA, 25 bp, Mus musculus
tttcccgactgagagcttggacaga

SEQ ID NO: 968347 - DNA, 25 bp, Mus musculus
tttcccgagatgacagtattttgca

SEQ ID NO: 968348 - DNA, 25 bp, Mus musculus
tttcccgagatgtcagtattttgca

SEQ ID NO: 968349 - DNA, 25 bp, Mus musculus
tttcccgagtccaccttgaatgtat

SEQ ID NO: 968350 - DNA, 25 bp, Mus musculus
tttcccgagtcctccttgaatgtat

SEQ ID NO: 968351 - DNA, 25 bp, Mus musculus
tttcccgatatgagttagacacccc

SEQ ID NO: 968352 - DNA, 25 bp, Mus musculus
tttcccgatatgtgttagacacccc

SEQ ID NO: 968353 - DNA, 25 bp, Mus musculus
tttcccgcaatcactatagatctgt

SEQ ID NO: 968354 - DNA, 25 bp, Mus musculus
tttcccgcaatctctatagatctgt

SEQ ID NO: 968355 - DNA, 25 bp, Mus musculus
tttcccgccatcagggtccagtgca

SEQ ID NO: 968356 - DNA, 25 bp, Mus musculus
tttcccgccatctgggtccagtgca

SEQ ID NO: 968357 - DNA, 25 bp, Mus musculus
tttcccgccctcatctgtaaatgaa

SEQ ID NO: 968358 - DNA, 25 bp, Mus musculus
tttcccgccctcttctgtaaatgaa

SEQ ID NO: 968359 - DNA, 25 bp, Mus musculus
tttcccgcctaaactgctgggcaga

SEQ ID NO: 968360 - DNA, 25 bp, Mus musculus
tttcccgcctaatctgctgggcaga

SEQ ID NO: 968361 - DNA, 25 bp, Mus musculus
tttcccgcctcgcagtatcagagtg

SEQ ID NO: 968362 - DNA, 25 bp, Mus musculus
tttcccgcctcggagtatcagagtg

SEQ ID NO: 968363 - DNA, 25 bp, Mus musculus
tttcccgggtgcaaggctccaggta

SEQ ID NO: 968364 - DNA, 25 bp, Mus musculus
tttcccgggtgctaggctccaggta

SEQ ID NO: 968365 - DNA, 25 bp, Mus musculus
tttcccggtcaaactgtgtggacat

SEQ ID NO: 968366 - DNA, 25 bp, Mus musculus
tttcccggtcaatctgtgtggacat

SEQ ID NO: 968367 - DNA, 25 bp, Mus musculus
tttcccggtgaaagaaaccgaggtg

SEQ ID NO: 968368 - DNA, 25 bp, Mus musculus
tttcccggtgaatgaaaccgaggtg

SEQ ID NO: 968369 - DNA, 25 bp, Mus musculus
tttcccgtcataaacattgtgctta

SEQ ID NO: 968370 - DNA, 25 bp, Mus musculus
tttcccgtcatatacattgtgctta

SEQ ID NO: 968371 - DNA, 25 bp, Mus musculus
tttcccgtcattactctaaaactgc

SEQ ID NO: 968372 - DNA, 25 bp, Mus musculus
tttcccgtcatttctctaaaactgc

SEQ ID NO: 968373 - DNA, 25 bp, Mus musculus
tttcccgtcggacctgcacaaacaa

SEQ ID NO: 968374 - DNA, 25 bp, Mus musculus
tttcccgtcggagctgcacaaacaa

SEQ ID NO: 968375 - DNA, 25 bp, Mus musculus
tttcccgtgactattctccaaagag

SEQ ID NO: 968376 - DNA, 25 bp, Mus musculus
tttcccgtgacttttctccaaagag

SEQ ID NO: 968377 - DNA, 25 bp, Mus musculus
tttcccgttggaagacgactgtctt

SEQ ID NO: 968378 - DNA, 25 bp, Mus musculus
tttcccgttggatgacgactgtctt

SEQ ID NO: 968379 - DNA, 25 bp, Mus musculus
tttccctaacatcttctactcagat

SEQ ID NO: 968380 - DNA, 25 bp, Mus musculus
tttccctaacatgttctactcagat

SEQ ID NO: 968381 - DNA, 25 bp, Mus musculus
tttccctaagatcccaactccagag

SEQ ID NO: 968382 - DNA, 25 bp, Mus musculus
tttccctaagatgccaactccagag

SEQ ID NO: 968383 - DNA, 25 bp, Mus musculus
tttccctaagccagcatggctgcta

SEQ ID NO: 968384 - DNA, 25 bp, Mus musculus
tttccctaagcctgcatggctgcta

SEQ ID NO: 968385 - DNA, 25 bp, Mus musculus
tttccctaattcagttcatcattta

SEQ ID NO: 968386 - DNA, 25 bp, Mus musculus
tttccctaattccacagctgttcaa

SEQ ID NO: 968387 - DNA, 25 bp, Mus musculus
tttccctaattcgacagctgttcaa

SEQ ID NO: 968388 - DNA, 25 bp, Mus musculus
tttccctaattctgttcatcattta

SEQ ID NO: 968389 - DNA, 25 bp, Mus musculus
tttccctacactaagaatacatggt

SEQ ID NO: 968390 - DNA, 25 bp, Mus musculus
tttccctacacttagaatacatggt

SEQ ID NO: 968391 - DNA, 25 bp, Mus musculus
tttccctacatcacagacttttgtt

SEQ ID NO: 968392 - DNA, 25 bp, Mus musculus
tttccctacatctcagacttttgtt

SEQ ID NO: 968393 - DNA, 25 bp, Mus musculus
tttccctaccaacatgcatccagga

SEQ ID NO: 968394 - DNA, 25 bp, Mus musculus
tttccctaccaagatgcatccagga

SEQ ID NO: 968395 - DNA, 25 bp, Mus musculus
tttccctaccatcttataaattatt

SEQ ID NO: 968396 - DNA, 25 bp, Mus musculus
tttccctaccatgttataaattatt

SEQ ID NO: 968397 - DNA, 25 bp, Mus musculus
tttccctaccgtctactcagtaagt

SEQ ID NO: 968398 - DNA, 25 bp, Mus musculus
tttccctaccgtgtactcagtaagt

SEQ ID NO: 968399 - DNA, 25 bp, Mus musculus
tttccctacctgagatacattctgg

SEQ ID NO: 968400 - DNA, 25 bp, Mus musculus
tttccctacctgtgatacattctgg

SEQ ID NO: 968401 - DNA, 25 bp, Mus musculus
tttccctactctcgtgcttatctga

SEQ ID NO: 968402 - DNA, 25 bp, Mus musculus
tttccctactctggtgcttatctga

SEQ ID NO: 968403 - DNA, 25 bp, Mus musculus
tttccctactgacgtggctgacctc

SEQ ID NO: 968404 - DNA, 25 bp, Mus musculus
tttccctactgaggtggctgacctc

SEQ ID NO: 968405 - DNA, 25 bp, Mus musculus
tttccctactgtacacggagaaata

SEQ ID NO: 968406 - DNA, 25 bp, Mus musculus
tttccctactgttcacggagaaata

SEQ ID NO: 968407 - DNA, 25 bp, Mus musculus
tttccctagcaactcaaagtcgttc

SEQ ID NO: 968408 - DNA, 25 bp, Mus musculus
tttccctagcaacttgttcctagag

SEQ ID NO: 968409 - DNA, 25 bp, Mus musculus
tttccctagcaagtcaaagtcgttc

SEQ ID NO: 968410 - DNA, 25 bp, Mus musculus
tttccctagcaagttgttcctagag

SEQ ID NO: 968411 - DNA, 25 bp, Mus musculus
tttccctagcagaggatatttggtt

SEQ ID NO: 968412 - DNA, 25 bp, Mus musculus
tttccctagcagtggatatttggtt

SEQ ID NO: 968413 - DNA, 25 bp, Mus musculus
tttccctaggatacttgtttgctgg

SEQ ID NO: 968414 - DNA, 25 bp, Mus musculus
tttccctaggattcttgtttgctgg

SEQ ID NO: 968415 - DNA, 25 bp, Mus musculus
tttccctagtgacctcatgtgttga

SEQ ID NO: 968416 - DNA, 25 bp, Mus musculus
tttccctagtgagctcatgtgttga

SEQ ID NO: 968417 - DNA, 25 bp, Mus musculus
tttccctataatagccccaccgtat

SEQ ID NO: 968418 - DNA, 25 bp, Mus musculus
tttccctataattgccccaccgtat

SEQ ID NO: 968419 - DNA, 25 bp, Mus musculus
tttccctatgtccttaaatccagtg

SEQ ID NO: 968420 - DNA, 25 bp, Mus musculus
tttccctatgtcgttaaatccagtg

SEQ ID NO: 968421 - DNA, 25 bp, Mus musculus
tttccctcacacaagtataagatgc

SEQ ID NO: 968422 - DNA, 25 bp, Mus musculus
tttccctcacacatagagccactaa

SEQ ID NO: 968423 - DNA, 25 bp, Mus musculus
tttccctcacactagtataagatgc

SEQ ID NO: 968424 - DNA, 25 bp, Mus musculus
tttccctcacacttagagccactaa

SEQ ID NO: 968425 - DNA, 25 bp, Mus musculus
tttccctcacttaccagaagaccaa

SEQ ID NO: 968426 - DNA, 25 bp, Mus musculus
tttccctcactttccagaagaccaa

SEQ ID NO: 968427 - DNA, 25 bp, Mus musculus
tttccctcagaaagacaatcccctg

SEQ ID NO: 968428 - DNA, 25 bp, Mus musculus
tttccctcagaatgacaatcccctg

SEQ ID NO: 968429 - DNA, 25 bp, Mus musculus
tttccctcagatagcagcggccatg

SEQ ID NO: 968430 - DNA, 25 bp, Mus musculus
tttccctcagattgcagcggccatg

SEQ ID NO: 968431 - DNA, 25 bp, Mus musculus
tttccctcagcaacaagacctgtgc

SEQ ID NO: 968432 - DNA, 25 bp, Mus musculus
tttccctcagcatcaagacctgtgc

SEQ ID NO: 968433 - DNA, 25 bp, Mus musculus
tttccctcagggaagagtgcctgta

SEQ ID NO: 968434 - DNA, 25 bp, Mus musculus
tttccctcagggagttcgtgaatgc

SEQ ID NO: 968435 - DNA, 25 bp, Mus musculus
tttccctcagggtagagtgcctgta

SEQ ID NO: 968436 - DNA, 25 bp, Mus musculus
tttccctcagggtgttcgtgaatgc

SEQ ID NO: 968437 - DNA, 25 bp, Mus musculus
tttccctcatacatagctctgacaa

SEQ ID NO: 968438 - DNA, 25 bp, Mus musculus
tttccctcatacttagctctgacaa

SEQ ID NO: 968439 - DNA, 25 bp, Mus musculus
tttccctcatgtcggttctgactga

SEQ ID NO: 968440 - DNA, 25 bp, Mus musculus
tttccctcatgtgggttctgactga

SEQ ID NO: 968441 - DNA, 25 bp, Mus musculus
tttccctccaggactcacaaaggaa

SEQ ID NO: 968442 - DNA, 25 bp, Mus musculus
tttccctccaggtctcacaaaggaa

SEQ ID NO: 968443 - DNA, 25 bp, Mus musculus
tttccctccataccaatatattata

SEQ ID NO: 968444 - DNA, 25 bp, Mus musculus
tttccctccatagcaatatattata

SEQ ID NO: 968445 - DNA, 25 bp, Mus musculus
tttccctcccacaagttacatgtga

SEQ ID NO: 968446 - DNA, 25 bp, Mus musculus
tttccctcccactagttacatgtga

SEQ ID NO: 968447 - DNA, 25 bp, Mus musculus
tttccctccctgacttaagacagta

SEQ ID NO: 968448 - DNA, 25 bp, Mus musculus
tttccctccctgtcttaagacagta

SEQ ID NO: 968449 - DNA, 25 bp, Mus musculus
tttccctcccttatccagtagcaat

SEQ ID NO: 968450 - DNA, 25 bp, Mus musculus
tttccctcccttctgaagtcagggt

SEQ ID NO: 968451 - DNA, 25 bp, Mus musculus
tttccctcccttgtgaagtcagggt

SEQ ID NO: 968452 - DNA, 25 bp, Mus musculus
tttccctcccttttccagtagcaat

SEQ ID NO: 968453 - DNA, 25 bp, Mus musculus
tttccctcctgacagatagtctaga

SEQ ID NO: 968454 - DNA, 25 bp, Mus musculus
tttccctcctgagagatagtctaga

SEQ ID NO: 968455 - DNA, 25 bp, Mus musculus
tttccctcctgtaaatctgctgttg

SEQ ID NO: 968456 - DNA, 25 bp, Mus musculus
tttccctcctgttaatctgctgttg

SEQ ID NO: 968457 - DNA, 25 bp, Mus musculus
tttccctccttacacattcattgtt

SEQ ID NO: 968458 - DNA, 25 bp, Mus musculus
tttccctccttagacattcattgtt

SEQ ID NO: 968459 - DNA, 25 bp, Mus musculus
tttccctcgagcaatacctcatgga

SEQ ID NO: 968460 - DNA, 25 bp, Mus musculus
tttccctcgagctatacctcatgga

SEQ ID NO: 968461 - DNA, 25 bp, Mus musculus
tttccctcgcccagagatatgtggc

SEQ ID NO: 968462 - DNA, 25 bp, Mus musculus
tttccctcgccctgagatatgtggc

SEQ ID NO: 968463 - DNA, 25 bp, Mus musculus
tttccctcggtaaacatcccataag

SEQ ID NO: 968464 - DNA, 25 bp, Mus musculus
tttccctcggtatacatcccataag

SEQ ID NO: 968465 - DNA, 25 bp, Mus musculus
tttccctctcatctacgaagtgtgg

SEQ ID NO: 968466 - DNA, 25 bp, Mus musculus
tttccctctcatgtacgaagtgtgg

SEQ ID NO: 968467 - DNA, 25 bp, Mus musculus
tttccctctgaaccacttaggagct

SEQ ID NO: 968468 - DNA, 25 bp, Mus musculus
tttccctctgaagcacttaggagct

SEQ ID NO: 968469 - DNA, 25 bp, Mus musculus
tttccctctgctatcagttattgag

SEQ ID NO: 968470 - DNA, 25 bp, Mus musculus
tttccctctgctttcagttattgag

SEQ ID NO: 968471 - DNA, 25 bp, Mus musculus
tttccctctggaatttatcgtgcag

SEQ ID NO: 968472 - DNA, 25 bp, Mus musculus
tttccctctggattttatcgtgcag

SEQ ID NO: 968473 - DNA, 25 bp, Mus musculus
tttccctctgtgaagcatccaggta

SEQ ID NO: 968474 - DNA, 25 bp, Mus musculus
tttccctctgtgacctgttatttca

SEQ ID NO: 968475 - DNA, 25 bp, Mus musculus
tttccctctgtgtagcatccaggta

SEQ ID NO: 968476 - DNA, 25 bp, Mus musculus
tttccctctgtgtcctgttatttca

SEQ ID NO: 968477 - DNA, 25 bp, Mus musculus
tttccctctttcacagcatttgtca

SEQ ID NO: 968478 - DNA, 25 bp, Mus musculus
tttccctctttctcagcatttgtca

SEQ ID NO: 968479 - DNA, 25 bp, Mus musculus
tttccctgaaaactcctgtcactaa

SEQ ID NO: 968480 - DNA, 25 bp, Mus musculus
tttccctgaaaagtcctgtcactaa

SEQ ID NO: 968481 - DNA, 25 bp, Mus musculus
tttccctgaaatacagccagactgg

SEQ ID NO: 968482 - DNA, 25 bp, Mus musculus
tttccctgaaattcagccagactgg

SEQ ID NO: 968483 - DNA, 25 bp, Mus musculus
tttccctgaagtaccgtaagtacat

SEQ ID NO: 968484 - DNA, 25 bp, Mus musculus
tttccctgaagttccgtaagtacat

SEQ ID NO: 968485 - DNA, 25 bp, Mus musculus
tttccctgactgagcccatgaagaa

SEQ ID NO: 968486 - DNA, 25 bp, Mus musculus
tttccctgactgtgcccatgaagaa

SEQ ID NO: 968487 - DNA, 25 bp, Mus musculus
tttccctgagctctttcctaaaaga

SEQ ID NO: 968488 - DNA, 25 bp, Mus musculus
tttccctgagctgtttcctaaaaga

SEQ ID NO: 968489 - DNA, 25 bp, Mus musculus
tttccctgataacccgacatgagca

SEQ ID NO: 968490 - DNA, 25 bp, Mus musculus
tttccctgataagccgacatgagca

SEQ ID NO: 968491 - DNA, 25 bp, Mus musculus
tttccctgattcagatggctgcaca

SEQ ID NO: 968492 - DNA, 25 bp, Mus musculus
tttccctgattctgatggctgcaca

SEQ ID NO: 968493 - DNA, 25 bp, Mus musculus
tttccctgattgctgagcataactg

SEQ ID NO: 968494 - DNA, 25 bp, Mus musculus
tttccctgattggtgagcataactg

SEQ ID NO: 968495 - DNA, 25 bp, Mus musculus
tttccctgatttaattgtaattgct

SEQ ID NO: 968496 - DNA, 25 bp, Mus musculus
tttccctgattttattgtaattgct

SEQ ID NO: 968497 - DNA, 25 bp, Mus musculus
tttccctgcaaaacagtgttgactg

SEQ ID NO: 968498 - DNA, 25 bp, Mus musculus
tttccctgcaaatcagtgttgactg

SEQ ID NO: 968499 - DNA, 25 bp, Mus musculus
tttccctgcactcagtgtggtaaga

SEQ ID NO: 968500 - DNA, 25 bp, Mus musculus
tttccctgcactgagtgtggtaaga

SEQ ID NO: 968501 - DNA, 25 bp, Mus musculus
tttccctgcagaagaacacatagct

SEQ ID NO: 968502 - DNA, 25 bp, Mus musculus
tttccctgcagatgaacacatagct

SEQ ID NO: 968503 - DNA, 25 bp, Mus musculus
tttccctgccagacattcttctatt

SEQ ID NO: 968504 - DNA, 25 bp, Mus musculus
tttccctgccagagtacgcaatcaa

SEQ ID NO: 968505 - DNA, 25 bp, Mus musculus
tttccctgccagtcattcttctatt

SEQ ID NO: 968506 - DNA, 25 bp, Mus musculus
tttccctgccagtgtacgcaatcaa

SEQ ID NO: 968507 - DNA, 25 bp, Mus musculus
tttccctgccctaagaaacagaaag

SEQ ID NO: 968508 - DNA, 25 bp, Mus musculus
tttccctgcccttagaaacagaaag

SEQ ID NO: 968509 - DNA, 25 bp, Mus musculus
tttccctgctagactgttgacaacg

SEQ ID NO: 968510 - DNA, 25 bp, Mus musculus
tttccctgctagtctgttgacaacg

SEQ ID NO: 968511 - DNA, 25 bp, Mus musculus
tttccctgctctcggcagattgaaa

SEQ ID NO: 968512 - DNA, 25 bp, Mus musculus
tttccctgctctgggcagattgaaa

SEQ ID NO: 968513 - DNA, 25 bp, Mus musculus
tttccctgcttacatgggttgccac

SEQ ID NO: 968514 - DNA, 25 bp, Mus musculus
tttccctgcttagatgggttgccac

SEQ ID NO: 968515 - DNA, 25 bp, Mus musculus
tttccctgcttcacaacctatggag

SEQ ID NO: 968516 - DNA, 25 bp, Mus musculus
tttccctgcttctcaacctatggag

SEQ ID NO: 968517 - DNA, 25 bp, Mus musculus
tttccctggaatatcaccttaaatg

SEQ ID NO: 968518 - DNA, 25 bp, Mus musculus
tttccctggaatttcaccttaaatg

SEQ ID NO: 968519 - DNA, 25 bp, Mus musculus
tttccctggactagcatccagaaga

SEQ ID NO: 968520 - DNA, 25 bp, Mus musculus
tttccctggacttgcatccagaaga

SEQ ID NO: 968521 - DNA, 25 bp, Mus musculus
tttccctggagacgcagactgagca

SEQ ID NO: 968522 - DNA, 25 bp, Mus musculus
tttccctggagaggcagactgagca

SEQ ID NO: 968523 - DNA, 25 bp, Mus musculus
tttccctggccaaaagtgttcttta

SEQ ID NO: 968524 - DNA, 25 bp, Mus musculus
tttccctggccataagtgttcttta

SEQ ID NO: 968525 - DNA, 25 bp, Mus musculus
tttccctgggttcaagatgaactca

SEQ ID NO: 968526 - DNA, 25 bp, Mus musculus
tttccctgggttgaagatgaactca

SEQ ID NO: 968527 - DNA, 25 bp, Mus musculus
tttccctgtaagatcctaccacaag

SEQ ID NO: 968528 - DNA, 25 bp, Mus musculus
tttccctgtaagatttgtacagcta

SEQ ID NO: 968529 - DNA, 25 bp, Mus musculus
tttccctgtaagttcctaccacaag

SEQ ID NO: 968530 - DNA, 25 bp, Mus musculus
tttccctgtaagttttgtacagcta

SEQ ID NO: 968531 - DNA, 25 bp, Mus musculus
tttccctgtacccactgcagaggaa

SEQ ID NO: 968532 - DNA, 25 bp, Mus musculus
tttccctgtaccgactgcagaggaa

SEQ ID NO: 968533 - DNA, 25 bp, Mus musculus
tttccctgtactactttacaattgt

SEQ ID NO: 968534 - DNA, 25 bp, Mus musculus
tttccctgtacttctttacaattgt

SEQ ID NO: 968535 - DNA, 25 bp, Mus musculus
tttccctgtcctatagtcactgttg

SEQ ID NO: 968536 - DNA, 25 bp, Mus musculus
tttccctgtcctcaatgcacctgtg

SEQ ID NO: 968537 - DNA, 25 bp, Mus musculus
tttccctgtcctgaatgcacctgtg

SEQ ID NO: 968538 - DNA, 25 bp, Mus musculus
tttccctgtcctttagtcactgttg

SEQ ID NO: 968539 - DNA, 25 bp, Mus musculus
tttccctgtctacaaactgcattga

SEQ ID NO: 968540 - DNA, 25 bp, Mus musculus
tttccctgtctagaaactgcattga

SEQ ID NO: 968541 - DNA, 25 bp, Mus musculus
tttccctgtgacctgctaagggcag

SEQ ID NO: 968542 - DNA, 25 bp, Mus musculus
tttccctgtgacgtgctaagggcag

SEQ ID NO: 968543 - DNA, 25 bp, Mus musculus
tttccctgtggtaccttgcaaaata

SEQ ID NO: 968544 - DNA, 25 bp, Mus musculus
tttccctgtggtcacttttgtttgc

SEQ ID NO: 968545 - DNA, 25 bp, Mus musculus
tttccctgtggtcgaagtgtggtca

SEQ ID NO: 968546 - DNA, 25 bp, Mus musculus
tttccctgtggtgacttttgtttgc

SEQ ID NO: 968547 - DNA, 25 bp, Mus musculus
tttccctgtggtggaagtgtggtca

SEQ ID NO: 968548 - DNA, 25 bp, Mus musculus
tttccctgtggttccttgcaaaata

SEQ ID NO: 968549 - DNA, 25 bp, Mus musculus
tttccctgttacatgttcttgataa

SEQ ID NO: 968550 - DNA, 25 bp, Mus musculus
tttccctgttacttgttcttgataa

SEQ ID NO: 968551 - DNA, 25 bp, Mus musculus
tttccctgttccaaagtggcataaa

SEQ ID NO: 968552 - DNA, 25 bp, Mus musculus
tttccctgttccctgcggacaaaag

SEQ ID NO: 968553 - DNA, 25 bp, Mus musculus
tttccctgttccgtgcggacaaaag

SEQ ID NO: 968554 - DNA, 25 bp, Mus musculus
tttccctgttcctaagtggcataaa

SEQ ID NO: 968555 - DNA, 25 bp, Mus musculus
tttcccttacatattagagactctg

SEQ ID NO: 968556 - DNA, 25 bp, Mus musculus
tttcccttacattttagagactctg

SEQ ID NO: 968557 - DNA, 25 bp, Mus musculus
tttcccttacgtactgctacgcaat

SEQ ID NO: 968558 - DNA, 25 bp, Mus musculus
tttcccttacgttctgctacgcaat

SEQ ID NO: 968559 - DNA, 25 bp, Mus musculus
tttcccttactgaagcatagaccat

SEQ ID NO: 968560 - DNA, 25 bp, Mus musculus
tttcccttactgagcatctgcctga

SEQ ID NO: 968561 - DNA, 25 bp, Mus musculus
tttcccttactgtagcatagaccat

SEQ ID NO: 968562 - DNA, 25 bp, Mus musculus
tttcccttactgtgcatctgcctga

SEQ ID NO: 968563 - DNA, 25 bp, Mus musculus
tttcccttagaacgctcattctatt

SEQ ID NO: 968564 - DNA, 25 bp, Mus musculus
tttcccttagaaggctcattctatt

SEQ ID NO: 968565 - DNA, 25 bp, Mus musculus
tttcccttagagatggcggtcttca

SEQ ID NO: 968566 - DNA, 25 bp, Mus musculus
tttcccttagagttggcggtcttca

SEQ ID NO: 968567 - DNA, 25 bp, Mus musculus
tttcccttaggaaatgggcagctct

SEQ ID NO: 968568 - DNA, 25 bp, Mus musculus
tttcccttaggatatgggcagctct

SEQ ID NO: 968569 - DNA, 25 bp, Mus musculus
tttcccttatagacgcagagatttg

SEQ ID NO: 968570 - DNA, 25 bp, Mus musculus
tttcccttatagtcgcagagatttg

SEQ ID NO: 968571 - DNA, 25 bp, Mus musculus
tttcccttatcaacccattaacatt

SEQ ID NO: 968572 - DNA, 25 bp, Mus musculus
tttcccttatcatcccattaacatt

SEQ ID NO: 968573 - DNA, 25 bp, Mus musculus
tttcccttcaggattcagcacagaa

SEQ ID NO: 968574 - DNA, 25 bp, Mus musculus
tttcccttcaggtttcagcacagaa

SEQ ID NO: 968575 - DNA, 25 bp, Mus musculus
tttcccttcatgaatctgaggattt

SEQ ID NO: 968576 - DNA, 25 bp, Mus musculus
tttcccttcatgtatctgaggattt

SEQ ID NO: 968577 - DNA, 25 bp, Mus musculus
tttcccttccacatttgctcatttc

SEQ ID NO: 968578 - DNA, 25 bp, Mus musculus
tttcccttccacttttgctcatttc

SEQ ID NO: 968579 - DNA, 25 bp, Mus musculus
tttcccttcgggaggatcaaatccg

SEQ ID NO: 968580 - DNA, 25 bp, Mus musculus
tttcccttcgggtggatcaaatccg

SEQ ID NO: 968581 - DNA, 25 bp, Mus musculus
tttcccttctatactttgacttggc

SEQ ID NO: 968582 - DNA, 25 bp, Mus musculus
tttcccttctattctttgacttggc

SEQ ID NO: 968583 - DNA, 25 bp, Mus musculus
tttcccttctctctgtagtttgaca

SEQ ID NO: 968584 - DNA, 25 bp, Mus musculus
tttcccttctctgtgtagtttgaca

SEQ ID NO: 968585 - DNA, 25 bp, Mus musculus
tttcccttgaaaatccatgttaacg

SEQ ID NO: 968586 - DNA, 25 bp, Mus musculus
tttcccttgaaattccatgttaacg

SEQ ID NO: 968587 - DNA, 25 bp, Mus musculus
tttcccttgatgatcccactaacat

SEQ ID NO: 968588 - DNA, 25 bp, Mus musculus
tttcccttgatgttcccactaacat

SEQ ID NO: 968589 - DNA, 25 bp, Mus musculus
tttcccttgcacagggttgacatag

SEQ ID NO: 968590 - DNA, 25 bp, Mus musculus
tttcccttgcacatttctgaaccag

SEQ ID NO: 968591 - DNA, 25 bp, Mus musculus
tttcccttgcactgggttgacatag

SEQ ID NO: 968592 - DNA, 25 bp, Mus musculus
tttcccttgcacttttctgaaccag

SEQ ID NO: 968593 - DNA, 25 bp, Mus musculus
tttcccttgcttcgccagacaggca

SEQ ID NO: 968594 - DNA, 25 bp, Mus musculus
tttcccttgcttctcgtccgtgctg

SEQ ID NO: 968595 - DNA, 25 bp, Mus musculus
tttcccttgcttggccagacaggca

SEQ ID NO: 968596 - DNA, 25 bp, Mus musculus
tttcccttgcttgtcgtccgtgctg

SEQ ID NO: 968597 - DNA, 25 bp, Mus musculus
tttcccttggccagatatgcactaa

SEQ ID NO: 968598 - DNA, 25 bp, Mus musculus
tttcccttggcctgatatgcactaa

SEQ ID NO: 968599 - DNA, 25 bp, Mus musculus
tttcccttggttaactatagataat

SEQ ID NO: 968600 - DNA, 25 bp, Mus musculus
tttcccttggtttactatagataat

SEQ ID NO: 968601 - DNA, 25 bp, Mus musculus
tttcccttgtagctgtttctcttgt

SEQ ID NO: 968602 - DNA, 25 bp, Mus musculus
tttcccttgtaggtgtttctcttgt

SEQ ID NO: 968603 - DNA, 25 bp, Mus musculus
tttcccttgtccagtcttaactata

SEQ ID NO: 968604 - DNA, 25 bp, Mus musculus
tttcccttgtcctgtcttaactata

SEQ ID NO: 968605 - DNA, 25 bp, Mus musculus
tttccctttagtcctttgcttcaat

SEQ ID NO: 968606 - DNA, 25 bp, Mus musculus
tttccctttagtgctttgcttcaat

SEQ ID NO: 968607 - DNA, 25 bp, Mus musculus
tttccctttcacagttggagacctg

SEQ ID NO: 968608 - DNA, 25 bp, Mus musculus
tttccctttcactgttggagacctg

SEQ ID NO: 968609 - DNA, 25 bp, Mus musculus
tttccctttcgtcatgaccttgaag

SEQ ID NO: 968610 - DNA, 25 bp, Mus musculus
tttccctttcgtgatgaccttgaag

SEQ ID NO: 968611 - DNA, 25 bp, Mus musculus
tttccctttggacttgatgtatatt

SEQ ID NO: 968612 - DNA, 25 bp, Mus musculus
tttccctttggagttgatgtatatt

SEQ ID NO: 968613 - DNA, 25 bp, Mus musculus
tttcccttttggcactggatgggtg

SEQ ID NO: 968614 - DNA, 25 bp, Mus musculus
tttcccttttgggactggatgggtg

SEQ ID NO: 968615 - DNA, 25 bp, Mus musculus
tttccctttttgaggcccaaacatg

SEQ ID NO: 968616 - DNA, 25 bp, Mus musculus
tttccctttttgtggcccaaacatg

SEQ ID NO: 968617 - DNA, 25 bp, Mus musculus
tttccgaagaatacaggatcccttc

SEQ ID NO: 968618 - DNA, 25 bp, Mus musculus
tttccgaagaattcaggatcccttc

SEQ ID NO: 968619 - DNA, 25 bp, Mus musculus
tttccgaagcccactgaataaggag

SEQ ID NO: 968620 - DNA, 25 bp, Mus musculus
tttccgaagccctctgaataaggag

SEQ ID NO: 968621 - DNA, 25 bp, Mus musculus
tttccgaagtccaagtaccgttctg

SEQ ID NO: 968622 - DNA, 25 bp, Mus musculus
tttccgaagtcctagtaccgttctg

SEQ ID NO: 968623 - DNA, 25 bp, Mus musculus
tttccgactgtgaatttctctggtt

SEQ ID NO: 968624 - DNA, 25 bp, Mus musculus
tttccgactgtgtatttctctggtt

SEQ ID NO: 968625 - DNA, 25 bp, Mus musculus
tttccgacttccacaggtctgaaat

SEQ ID NO: 968626 - DNA, 25 bp, Mus musculus
tttccgacttcctcaggtctgaaat

SEQ ID NO: 968627 - DNA, 25 bp, Mus musculus
tttccgagctgtcgtagcagcactt

SEQ ID NO: 968628 - DNA, 25 bp, Mus musculus
tttccgagctgtggtagcagcactt

SEQ ID NO: 968629 - DNA, 25 bp, Mus musculus
tttccgaggcctcagtgttgcatca

SEQ ID NO: 968630 - DNA, 25 bp, Mus musculus
tttccgaggcctgagtgttgcatca

SEQ ID NO: 968631 - DNA, 25 bp, Mus musculus
tttccgagtgctcgccttaattaga

SEQ ID NO: 968632 - DNA, 25 bp, Mus musculus
tttccgagtgctggccttaattaga

SEQ ID NO: 968633 - DNA, 25 bp, Mus musculus
tttccgatgcacctgctgttgcttc

SEQ ID NO: 968634 - DNA, 25 bp, Mus musculus
tttccgatgcacgtgctgttgcttc

SEQ ID NO: 968635 - DNA, 25 bp, Mus musculus
tttccgatgcttagcgcttataagc

SEQ ID NO: 968636 - DNA, 25 bp, Mus musculus
tttccgatgctttgcgcttataagc

SEQ ID NO: 968637 - DNA, 25 bp, Mus musculus
tttccgcaagtacactcaggctgag

SEQ ID NO: 968638 - DNA, 25 bp, Mus musculus
tttccgcaagtagactcaggctgag

SEQ ID NO: 968639 - DNA, 25 bp, Mus musculus
tttccgcagattcccaatgacaggt

SEQ ID NO: 968640 - DNA, 25 bp, Mus musculus
tttccgcagattgccaatgacaggt

SEQ ID NO: 968641 - DNA, 25 bp, Mus musculus
tttccgcatcctaatccatgcatgt

SEQ ID NO: 968642 - DNA, 25 bp, Mus musculus
tttccgcatccttatccatgcatgt

SEQ ID NO: 968643 - DNA, 25 bp, Mus musculus
tttccgccctatctacagacactgg

SEQ ID NO: 968644 - DNA, 25 bp, Mus musculus
tttccgccctatgtacagacactgg

SEQ ID NO: 968645 - DNA, 25 bp, Mus musculus
tttccgccggttccattaaagctat

SEQ ID NO: 968646 - DNA, 25 bp, Mus musculus
tttccgccggttgcattaaagctat

SEQ ID NO: 968647 - DNA, 25 bp, Mus musculus
tttccgctagacagccctgataaca

SEQ ID NO: 968648 - DNA, 25 bp, Mus musculus
tttccgctagactgccctgataaca

SEQ ID NO: 968649 - DNA, 25 bp, Mus musculus
tttccgctgagtccagattggcagg

SEQ ID NO: 968650 - DNA, 25 bp, Mus musculus
tttccgctgagtgcagattggcagg

SEQ ID NO: 968651 - DNA, 25 bp, Mus musculus
tttccgcttaagatggtattcacca

SEQ ID NO: 968652 - DNA, 25 bp, Mus musculus
tttccgcttaagttggtattcacca

SEQ ID NO: 968653 - DNA, 25 bp, Mus musculus
tttccgcttgaccttttcatacagt

SEQ ID NO: 968654 - DNA, 25 bp, Mus musculus
tttccgcttgacgttttcatacagt

SEQ ID NO: 968655 - DNA, 25 bp, Mus musculus
tttccggagccaaatcctggtttaa

SEQ ID NO: 968656 - DNA, 25 bp, Mus musculus
tttccggagccatatcctggtttaa

SEQ ID NO: 968657 - DNA, 25 bp, Mus musculus
tttccggaggagctgcgaaccacag

SEQ ID NO: 968658 - DNA, 25 bp, Mus musculus
tttccggaggaggtgcgaaccacag

SEQ ID NO: 968659 - DNA, 25 bp, Mus musculus
tttccggagggaccccactctgcta

SEQ ID NO: 968660 - DNA, 25 bp, Mus musculus
tttccggagggagcccactctgcta

SEQ ID NO: 968661 - DNA, 25 bp, Mus musculus
tttccggatcctagcccagatcact

SEQ ID NO: 968662 - DNA, 25 bp, Mus musculus
tttccggatccttgcccagatcact

SEQ ID NO: 968663 - DNA, 25 bp, Mus musculus
tttccggcaggcattcagaatctga

SEQ ID NO: 968664 - DNA, 25 bp, Mus musculus
tttccggcaggctttcagaatctga

SEQ ID NO: 968665 - DNA, 25 bp, Mus musculus
tttccggccggacagcagtcagata

SEQ ID NO: 968666 - DNA, 25 bp, Mus musculus
tttccggccggagagcagtcagata

SEQ ID NO: 968667 - DNA, 25 bp, Mus musculus
tttccggcgaaaatcagcacgagct

SEQ ID NO: 968668 - DNA, 25 bp, Mus musculus
tttccggcgaaattcagcacgagct

SEQ ID NO: 968669 - DNA, 25 bp, Mus musculus
tttccggcgtgaattatccgtctta

SEQ ID NO: 968670 - DNA, 25 bp, Mus musculus
tttccggcgtgatttatccgtctta

SEQ ID NO: 968671 - DNA, 25 bp, Mus musculus
tttccggtaataagctatgtccttt

SEQ ID NO: 968672 - DNA, 25 bp, Mus musculus
tttccggtaatatgctatgtccttt

SEQ ID NO: 968673 - DNA, 25 bp, Mus musculus
tttccggtggatattatacccagat

SEQ ID NO: 968674 - DNA, 25 bp, Mus musculus
tttccggtggattttatacccagat

SEQ ID NO: 968675 - DNA, 25 bp, Mus musculus
tttccggtttgaatgatggaggctt

SEQ ID NO: 968676 - DNA, 25 bp, Mus musculus
tttccggtttgattgatggaggctt

SEQ ID NO: 968677 - DNA, 25 bp, Mus musculus
tttccggtttttagccaggtgcaat

SEQ ID NO: 968678 - DNA, 25 bp, Mus musculus
tttccggttttttgccaggtgcaat

SEQ ID NO: 968679 - DNA, 25 bp, Mus musculus
tttccgtaaaggattatccaccaca

SEQ ID NO: 968680 - DNA, 25 bp, Mus musculus
tttccgtaaaggtttatccaccaca

SEQ ID NO: 968681 - DNA, 25 bp, Mus musculus
tttccgtaacccattcttgaatcat

SEQ ID NO: 968682 - DNA, 25 bp, Mus musculus
tttccgtaaccctttcttgaatcat

SEQ ID NO: 968683 - DNA, 25 bp, Mus musculus
tttccgtacagacgcctcaccttga

SEQ ID NO: 968684 - DNA, 25 bp, Mus musculus
tttccgtacagaggcctcaccttga

SEQ ID NO: 968685 - DNA, 25 bp, Mus musculus
tttccgtcacaaaaagcttcattag

SEQ ID NO: 968686 - DNA, 25 bp, Mus musculus
tttccgtcacaataagcttcattag

SEQ ID NO: 968687 - DNA, 25 bp, Mus musculus
tttccgtcctctatggtcattgcat

SEQ ID NO: 968688 - DNA, 25 bp, Mus musculus
tttccgtcctctttggtcattgcat

SEQ ID NO: 968689 - DNA, 25 bp, Mus musculus
tttccgtgaagaagtagcgcctcat

SEQ ID NO: 968690 - DNA, 25 bp, Mus musculus
tttccgtgaagatgtagcgcctcat

SEQ ID NO: 968691 - DNA, 25 bp, Mus musculus
tttccgtgccaccaggagcttctga

SEQ ID NO: 968692 - DNA, 25 bp, Mus musculus
tttccgtgccacgaggagcttctga

SEQ ID NO: 968693 - DNA, 25 bp, Mus musculus
tttccgtggagccaatgtcaagtta

SEQ ID NO: 968694 - DNA, 25 bp, Mus musculus
tttccgtggagcgaatgtcaagtta

SEQ ID NO: 968695 - DNA, 25 bp, Mus musculus
tttccgtggtaacttgcctgcacat

SEQ ID NO: 968696 - DNA, 25 bp, Mus musculus
tttccgtggtaagttgcctgcacat

SEQ ID NO: 968697 - DNA, 25 bp, Mus musculus
tttccgtgtattacctgggagttct

SEQ ID NO: 968698 - DNA, 25 bp, Mus musculus
tttccgtgtatttcctgggagttct

SEQ ID NO: 968699 - DNA, 25 bp, Mus musculus
tttccgttagcactccttactgctt

SEQ ID NO: 968700 - DNA, 25 bp, Mus musculus
tttccgttagcagtccttactgctt

SEQ ID NO: 968701 - DNA, 25 bp, Mus musculus
tttccgttcacacaaaggcgtatcc

SEQ ID NO: 968702 - DNA, 25 bp, Mus musculus
tttccgttcacagaaaggcgtatcc

SEQ ID NO: 968703 - DNA, 25 bp, Mus musculus
tttccgttccccagggtgtagcgag

SEQ ID NO: 968704 - DNA, 25 bp, Mus musculus
tttccgttcccctgggtgtagcgag

SEQ ID NO: 968705 - DNA, 25 bp, Mus musculus
tttccgttcctgattcatactgatt

SEQ ID NO: 968706 - DNA, 25 bp, Mus musculus
tttccgttcctgtttcatactgatt

SEQ ID NO: 968707 - DNA, 25 bp, Mus musculus
tttccgttcgacacttccaagatgg

SEQ ID NO: 968708 - DNA, 25 bp, Mus musculus
tttccgttcgactcttccaagatgg

SEQ ID NO: 968709 - DNA, 25 bp, Mus musculus
tttccgttttttcagattcttccag

SEQ ID NO: 968710 - DNA, 25 bp, Mus musculus
tttccgttttttgagattcttccag

SEQ ID NO: 968711 - DNA, 25 bp, Mus musculus
tttcctaaagccagagtcaagtcag

SEQ ID NO: 968712 - DNA, 25 bp, Mus musculus
tttcctaaagcccttgagcctgtag

SEQ ID NO: 968713 - DNA, 25 bp, Mus musculus
tttcctaaagccgttgagcctgtag

SEQ ID NO: 968714 - DNA, 25 bp, Mus musculus
tttcctaaagcctgagtcaagtcag

SEQ ID NO: 968715 - DNA, 25 bp, Mus musculus
tttcctaaatctctgccttagcttc

SEQ ID NO: 968716 - DNA, 25 bp, Mus musculus
tttcctaaatctgtgccttagcttc

SEQ ID NO: 968717 - DNA, 25 bp, Mus musculus
tttcctaaattcacctttgatacag

SEQ ID NO: 968718 - DNA, 25 bp, Mus musculus
tttcctaaattctcctttgatacag

SEQ ID NO: 968719 - DNA, 25 bp, Mus musculus
tttcctaacagccaatggagccgtg

SEQ ID NO: 968720 - DNA, 25 bp, Mus musculus
tttcctaacagcgaatggagccgtg

SEQ ID NO: 968721 - DNA, 25 bp, Mus musculus
tttcctaactcacgctagtggttgt

SEQ ID NO: 968722 - DNA, 25 bp, Mus musculus
tttcctaactcaggctagtggttgt

SEQ ID NO: 968723 - DNA, 25 bp, Mus musculus
tttcctaagactcctatctcatgct

SEQ ID NO: 968724 - DNA, 25 bp, Mus musculus
tttcctaagactgctatctcatgct

SEQ ID NO: 968725 - DNA, 25 bp, Mus musculus
tttcctaaggctcacaccgaaacct

SEQ ID NO: 968726 - DNA, 25 bp, Mus musculus
tttcctaaggctgacaccgaaacct

SEQ ID NO: 968727 - DNA, 25 bp, Mus musculus
tttcctaagggaccatttttggact

SEQ ID NO: 968728 - DNA, 25 bp, Mus musculus
tttcctaagggagcatttttggact

SEQ ID NO: 968729 - DNA, 25 bp, Mus musculus
tttcctaagggcacctcaggagtga

SEQ ID NO: 968730 - DNA, 25 bp, Mus musculus
tttcctaagggctcctcaggagtga

SEQ ID NO: 968731 - DNA, 25 bp, Mus musculus
tttcctaaggtcaaagggcttcaga

SEQ ID NO: 968732 - DNA, 25 bp, Mus musculus
tttcctaaggtctaagggcttcaga

SEQ ID NO: 968733 - DNA, 25 bp, Mus musculus
tttcctaagtggctgagctctccgt

SEQ ID NO: 968734 - DNA, 25 bp, Mus musculus
tttcctaagtgggtgagctctccgt

SEQ ID NO: 968735 - DNA, 25 bp, Mus musculus
tttcctaataccattggctgctgag

SEQ ID NO: 968736 - DNA, 25 bp, Mus musculus
tttcctaatacctttggctgctgag

SEQ ID NO: 968737 - DNA, 25 bp, Mus musculus
tttcctaatactccactaattggtt

SEQ ID NO: 968738 - DNA, 25 bp, Mus musculus
tttcctaatactgcactaattggtt

SEQ ID NO: 968739 - DNA, 25 bp, Mus musculus
tttcctaatcatcggatcacaggca

SEQ ID NO: 968740 - DNA, 25 bp, Mus musculus
tttcctaatcatgggatcacaggca

SEQ ID NO: 968741 - DNA, 25 bp, Mus musculus
tttcctaatggcaagcagattgaca

SEQ ID NO: 968742 - DNA, 25 bp, Mus musculus
tttcctaatggctagcagattgaca

SEQ ID NO: 968743 - DNA, 25 bp, Mus musculus
tttcctacaacaaatcagcaaacga

SEQ ID NO: 968744 - DNA, 25 bp, Mus musculus
tttcctacaacacagcctctaacaa

SEQ ID NO: 968745 - DNA, 25 bp, Mus musculus
tttcctacaacagagcctctaacaa

SEQ ID NO: 968746 - DNA, 25 bp, Mus musculus
tttcctacaacatatcagcaaacga

SEQ ID NO: 968747 - DNA, 25 bp, Mus musculus
tttcctacaaccagttaactgactg

SEQ ID NO: 968748 - DNA, 25 bp, Mus musculus
tttcctacaacctgttaactgactg

SEQ ID NO: 968749 - DNA, 25 bp, Mus musculus
tttcctacacaaatgactcttagtt

SEQ ID NO: 968750 - DNA, 25 bp, Mus musculus
tttcctacacaattgactcttagtt

SEQ ID NO: 968751 - DNA, 25 bp, Mus musculus
tttcctacactcctacactatgact

SEQ ID NO: 968752 - DNA, 25 bp, Mus musculus
tttcctacactcgtacactatgact

SEQ ID NO: 968753 - DNA, 25 bp, Mus musculus
tttcctacatttcctgtggcactag

SEQ ID NO: 968754 - DNA, 25 bp, Mus musculus
tttcctacatttgctgtggcactag

SEQ ID NO: 968755 - DNA, 25 bp, Mus musculus
tttcctacccagctgtctttggact

SEQ ID NO: 968756 - DNA, 25 bp, Mus musculus
tttcctacccaggtgtctttggact

SEQ ID NO: 968757 - DNA, 25 bp, Mus musculus
tttcctaccctgcatgaggcagagg

SEQ ID NO: 968758 - DNA, 25 bp, Mus musculus
tttcctaccctggatgaggcagagg

SEQ ID NO: 968759 - DNA, 25 bp, Mus musculus
tttcctaccgtccacagaacagttt

SEQ ID NO: 968760 - DNA, 25 bp, Mus musculus
tttcctaccgtcgacagaacagttt

SEQ ID NO: 968761 - DNA, 25 bp, Mus musculus
tttcctacctgtactgagaccacga

SEQ ID NO: 968762 - DNA, 25 bp, Mus musculus
tttcctacctgttctgagaccacga

SEQ ID NO: 968763 - DNA, 25 bp, Mus musculus
tttcctacctttctatttcgtgttg

SEQ ID NO: 968764 - DNA, 25 bp, Mus musculus
tttcctacctttgtatttcgtgttg

SEQ ID NO: 968765 - DNA, 25 bp, Mus musculus
tttcctacggaacctttggttgaat

SEQ ID NO: 968766 - DNA, 25 bp, Mus musculus
tttcctacggaagctttggttgaat

SEQ ID NO: 968767 - DNA, 25 bp, Mus musculus
tttcctactcaaatgttactcccca

SEQ ID NO: 968768 - DNA, 25 bp, Mus musculus
tttcctactcaattgttactcccca

SEQ ID NO: 968769 - DNA, 25 bp, Mus musculus
tttcctactctccactctggtaaat

SEQ ID NO: 968770 - DNA, 25 bp, Mus musculus
tttcctactctcgactctggtaaat

SEQ ID NO: 968771 - DNA, 25 bp, Mus musculus
tttcctactggaattccctttgtat

SEQ ID NO: 968772 - DNA, 25 bp, Mus musculus
tttcctactggatttccctttgtat

SEQ ID NO: 968773 - DNA, 25 bp, Mus musculus
tttcctactgtaccactgaagcact

SEQ ID NO: 968774 - DNA, 25 bp, Mus musculus
tttcctactgtagcactgaagcact

SEQ ID NO: 968775 - DNA, 25 bp, Mus musculus
tttcctactgtcaagatgctgccac

SEQ ID NO: 968776 - DNA, 25 bp, Mus musculus
tttcctactgtctagatgctgccac

SEQ ID NO: 968777 - DNA, 25 bp, Mus musculus
tttcctactgttccagatgcatctg

SEQ ID NO: 968778 - DNA, 25 bp, Mus musculus
tttcctactgttgcagatgcatctg

SEQ ID NO: 968779 - DNA, 25 bp, Mus musculus
tttcctagactgaacttggcaaaaa

SEQ ID NO: 968780 - DNA, 25 bp, Mus musculus
tttcctagactgtacttggcaaaaa

SEQ ID NO: 968781 - DNA, 25 bp, Mus musculus
tttcctagatctcccatgtggtcat

SEQ ID NO: 968782 - DNA, 25 bp, Mus musculus
tttcctagatctgccatgtggtcat

SEQ ID NO: 968783 - DNA, 25 bp, Mus musculus
tttcctagccaaactaatgaggtgt

SEQ ID NO: 968784 - DNA, 25 bp, Mus musculus
tttcctagccaatctaatgaggtgt

SEQ ID NO: 968785 - DNA, 25 bp, Mus musculus
tttcctagcccgctgctttgggtgc

SEQ ID NO: 968786 - DNA, 25 bp, Mus musculus
tttcctagcccggtgctttgggtgc

SEQ ID NO: 968787 - DNA, 25 bp, Mus musculus
tttcctagctatacaactttccgtt

SEQ ID NO: 968788 - DNA, 25 bp, Mus musculus
tttcctagctatactagcctaagcc

SEQ ID NO: 968789 - DNA, 25 bp, Mus musculus
tttcctagctattcaactttccgtt

SEQ ID NO: 968790 - DNA, 25 bp, Mus musculus
tttcctagctattctagcctaagcc

SEQ ID NO: 968791 - DNA, 25 bp, Mus musculus
tttcctaggaggctcttgacccata

SEQ ID NO: 968792 - DNA, 25 bp, Mus musculus
tttcctaggagggtcttgacccata

SEQ ID NO: 968793 - DNA, 25 bp, Mus musculus
tttcctaggccacagtcttctaaac

SEQ ID NO: 968794 - DNA, 25 bp, Mus musculus
tttcctaggccagagtcttctaaac

SEQ ID NO: 968795 - DNA, 25 bp, Mus musculus
tttcctagtaaaagttcacgtgcct

SEQ ID NO: 968796 - DNA, 25 bp, Mus musculus
tttcctagtaaatgttcacgtgcct

SEQ ID NO: 968797 - DNA, 25 bp, Mus musculus
tttcctagtcgccagctttgtgtgt

SEQ ID NO: 968798 - DNA, 25 bp, Mus musculus
tttcctagtcgcgagctttgtgtgt

SEQ ID NO: 968799 - DNA, 25 bp, Mus musculus
tttcctagtgtcatatttccaccca

SEQ ID NO: 968800 - DNA, 25 bp, Mus musculus
tttcctagtgtcttatttccaccca

SEQ ID NO: 968801 - DNA, 25 bp, Mus musculus
tttcctataaaaactctgtccccat

SEQ ID NO: 968802 - DNA, 25 bp, Mus musculus
tttcctataaaatctctgtccccat

SEQ ID NO: 968803 - DNA, 25 bp, Mus musculus
tttcctatagccactgtcctgtcgg

SEQ ID NO: 968804 - DNA, 25 bp, Mus musculus
tttcctatagcctctgtcctgtcgg

SEQ ID NO: 968805 - DNA, 25 bp, Mus musculus
tttcctataggtaatttgctgacag

SEQ ID NO: 968806 - DNA, 25 bp, Mus musculus
tttcctataggttatttgctgacag

SEQ ID NO: 968807 - DNA, 25 bp, Mus musculus
tttcctatcggacctatgctgtcaa

SEQ ID NO: 968808 - DNA, 25 bp, Mus musculus
tttcctatcggagctatgctgtcaa

SEQ ID NO: 968809 - DNA, 25 bp, Mus musculus
tttcctatctctacccatgttaaaa

SEQ ID NO: 968810 - DNA, 25 bp, Mus musculus
tttcctatctcttcccatgttaaaa

SEQ ID NO: 968811 - DNA, 25 bp, Mus musculus
tttcctatctgcaggatttgagttt

SEQ ID NO: 968812 - DNA, 25 bp, Mus musculus
tttcctatctgctggatttgagttt

SEQ ID NO: 968813 - DNA, 25 bp, Mus musculus
tttcctatcttacagtttttaatct

SEQ ID NO: 968814 - DNA, 25 bp, Mus musculus
tttcctatcttagagtttttaatct

SEQ ID NO: 968815 - DNA, 25 bp, Mus musculus
tttcctatggagcatgaagccctgt

SEQ ID NO: 968816 - DNA, 25 bp, Mus musculus
tttcctatggaggatgaagccctgt

SEQ ID NO: 968817 - DNA, 25 bp, Mus musculus
tttcctatggtaataactgtctttc

SEQ ID NO: 968818 - DNA, 25 bp, Mus musculus
tttcctatggtattaactgtctttc

SEQ ID NO: 968819 - DNA, 25 bp, Mus musculus
tttcctatgtgtaattgttgctgtc

SEQ ID NO: 968820 - DNA, 25 bp, Mus musculus
tttcctatgtgttattgttgctgtc

SEQ ID NO: 968821 - DNA, 25 bp, Mus musculus
tttcctattcaaactcacactgtgt

SEQ ID NO: 968822 - DNA, 25 bp, Mus musculus
tttcctattcaatctcacactgtgt

SEQ ID NO: 968823 - DNA, 25 bp, Mus musculus
tttcctattgcaagtcacttcccaa

SEQ ID NO: 968824 - DNA, 25 bp, Mus musculus
tttcctattgcatgtcacttcccaa

SEQ ID NO: 968825 - DNA, 25 bp, Mus musculus
tttcctattttgacgatggagccct

SEQ ID NO: 968826 - DNA, 25 bp, Mus musculus
tttcctattttgtcgatggagccct

SEQ ID NO: 968827 - DNA, 25 bp, Mus musculus
tttcctcaaagcatcaaaacccaga

SEQ ID NO: 968828 - DNA, 25 bp, Mus musculus
tttcctcaaagcttcaaaacccaga

SEQ ID NO: 968829 - DNA, 25 bp, Mus musculus
tttcctcaaaggacattcccaccta

SEQ ID NO: 968830 - DNA, 25 bp, Mus musculus
tttcctcaaaggagtgcctgcatgt

SEQ ID NO: 968831 - DNA, 25 bp, Mus musculus
tttcctcaaaggcatctgtcattcc

SEQ ID NO: 968832 - DNA, 25 bp, Mus musculus
tttcctcaaagggatctgtcattcc

SEQ ID NO: 968833 - DNA, 25 bp, Mus musculus
tttcctcaaaggtcattcccaccta

SEQ ID NO: 968834 - DNA, 25 bp, Mus musculus
tttcctcaaaggtgtgcctgcatgt

SEQ ID NO: 968835 - DNA, 25 bp, Mus musculus
tttcctcaaatgctgcaagagaaaa

SEQ ID NO: 968836 - DNA, 25 bp, Mus musculus
tttcctcaaatggtgcaagagaaaa

SEQ ID NO: 968837 - DNA, 25 bp, Mus musculus
tttcctcaactcaaacaatgccatc

SEQ ID NO: 968838 - DNA, 25 bp, Mus musculus
tttcctcaactctaacaatgccatc

SEQ ID NO: 968839 - DNA, 25 bp, Mus musculus
tttcctcaagctcatcaggttcgga

SEQ ID NO: 968840 - DNA, 25 bp, Mus musculus
tttcctcaagctgatcaggttcgga

SEQ ID NO: 968841 - DNA, 25 bp, Mus musculus
tttcctcacaggaagattctggttt

SEQ ID NO: 968842 - DNA, 25 bp, Mus musculus
tttcctcacaggtagattctggttt

SEQ ID NO: 968843 - DNA, 25 bp, Mus musculus
tttcctcaccaaccataagcagtat

SEQ ID NO: 968844 - DNA, 25 bp, Mus musculus
tttcctcaccaagcataagcagtat

SEQ ID NO: 968845 - DNA, 25 bp, Mus musculus
tttcctcacctaaggtaactgctac

SEQ ID NO: 968846 - DNA, 25 bp, Mus musculus
tttcctcacctatggtaactgctac

SEQ ID NO: 968847 - DNA, 25 bp, Mus musculus
tttcctcacctcatcctgggagaat

SEQ ID NO: 968848 - DNA, 25 bp, Mus musculus
tttcctcacctcttcctgggagaat

SEQ ID NO: 968849 - DNA, 25 bp, Mus musculus
tttcctcaccttcaagattcctgta

SEQ ID NO: 968850 - DNA, 25 bp, Mus musculus
tttcctcaccttgaagattcctgta

SEQ ID NO: 968851 - DNA, 25 bp, Mus musculus
tttcctcactacagggtgataggct

SEQ ID NO: 968852 - DNA, 25 bp, Mus musculus
tttcctcactactgggtgataggct

SEQ ID NO: 968853 - DNA, 25 bp, Mus musculus
tttcctcactcgaggctgccttcct

SEQ ID NO: 968854 - DNA, 25 bp, Mus musculus
tttcctcactcgtggctgccttcct

SEQ ID NO: 968855 - DNA, 25 bp, Mus musculus
tttcctcactgacaacccatgcagt

SEQ ID NO: 968856 - DNA, 25 bp, Mus musculus
tttcctcactgagaacccatgcagt

SEQ ID NO: 968857 - DNA, 25 bp, Mus musculus
tttcctcacttaaactgctcttcta

SEQ ID NO: 968858 - DNA, 25 bp, Mus musculus
tttcctcacttatactgctcttcta

SEQ ID NO: 968859 - DNA, 25 bp, Mus musculus
tttcctcacttgaccttggccactt

SEQ ID NO: 968860 - DNA, 25 bp, Mus musculus
tttcctcacttgtccttggccactt

SEQ ID NO: 968861 - DNA, 25 bp, Mus musculus
tttcctcactttacatccagttcat

SEQ ID NO: 968862 - DNA, 25 bp, Mus musculus
tttcctcacttttcatccagttcat

SEQ ID NO: 968863 - DNA, 25 bp, Mus musculus
tttcctcagaacagcgtttgggcaa

SEQ ID NO: 968864 - DNA, 25 bp, Mus musculus
tttcctcagaactgcgtttgggcaa

SEQ ID NO: 968865 - DNA, 25 bp, Mus musculus
tttcctcagaccatagactctcaga

SEQ ID NO: 968866 - DNA, 25 bp, Mus musculus
tttcctcagaccttagactctcaga

SEQ ID NO: 968867 - DNA, 25 bp, Mus musculus
tttcctcagactcacctggtttctt

SEQ ID NO: 968868 - DNA, 25 bp, Mus musculus
tttcctcagactgacctggtttctt

SEQ ID NO: 968869 - DNA, 25 bp, Mus musculus
tttcctcagaggcaagacgtaagca

SEQ ID NO: 968870 - DNA, 25 bp, Mus musculus
tttcctcagagggaagacgtaagca

SEQ ID NO: 968871 - DNA, 25 bp, Mus musculus
tttcctcaggaaccagcagattcat

SEQ ID NO: 968872 - DNA, 25 bp, Mus musculus
tttcctcaggaagcagcagattcat

SEQ ID NO: 968873 - DNA, 25 bp, Mus musculus
tttcctcaggctctctataaattcc

SEQ ID NO: 968874 - DNA, 25 bp, Mus musculus
tttcctcaggctgtctataaattcc

SEQ ID NO: 968875 - DNA, 25 bp, Mus musculus
tttcctcatcccaagacctgaataa

SEQ ID NO: 968876 - DNA, 25 bp, Mus musculus
tttcctcatccctagacctgaataa

SEQ ID NO: 968877 - DNA, 25 bp, Mus musculus
tttcctcatgccaaagtgttcttag

SEQ ID NO: 968878 - DNA, 25 bp, Mus musculus
tttcctcatgcctaagtgttcttag

SEQ ID NO: 968879 - DNA, 25 bp, Mus musculus
tttcctcatgtactagctgccaaaa

SEQ ID NO: 968880 - DNA, 25 bp, Mus musculus
tttcctcatgtagtagctgccaaaa

SEQ ID NO: 968881 - DNA, 25 bp, Mus musculus
tttcctcattctcgtgattgtgtcc

SEQ ID NO: 968882 - DNA, 25 bp, Mus musculus
tttcctcattctggtgattgtgtcc

SEQ ID NO: 968883 - DNA, 25 bp, Mus musculus
tttcctcattggaaacacctacctg

SEQ ID NO: 968884 - DNA, 25 bp, Mus musculus
tttcctcattggtaacacctacctg

SEQ ID NO: 968885 - DNA, 25 bp, Mus musculus
tttcctcatttaaagtcacattcag

SEQ ID NO: 968886 - DNA, 25 bp, Mus musculus
tttcctcatttatagtcacattcag

SEQ ID NO: 968887 - DNA, 25 bp, Mus musculus
tttcctccaaatcaatataaattct

SEQ ID NO: 968888 - DNA, 25 bp, Mus musculus
tttcctccaaatgaatataaattct

SEQ ID NO: 968889 - DNA, 25 bp, Mus musculus
tttcctccacagcaggcgagtacta

SEQ ID NO: 968890 - DNA, 25 bp, Mus musculus
tttcctccacaggaggcgagtacta

SEQ ID NO: 968891 - DNA, 25 bp, Mus musculus
tttcctccacatattagagtttcac

SEQ ID NO: 968892 - DNA, 25 bp, Mus musculus
tttcctccacattttagagtttcac

SEQ ID NO: 968893 - DNA, 25 bp, Mus musculus
tttcctccacggcagacttgaactg

SEQ ID NO: 968894 - DNA, 25 bp, Mus musculus
tttcctccacgggagacttgaactg

SEQ ID NO: 968895 - DNA, 25 bp, Mus musculus
tttcctccactccacggtgagggtg

SEQ ID NO: 968896 - DNA, 25 bp, Mus musculus
tttcctccactcgacggtgagggtg

SEQ ID NO: 968897 - DNA, 25 bp, Mus musculus
tttcctccagcaacaaagcataagt

SEQ ID NO: 968898 - DNA, 25 bp, Mus musculus
tttcctccagcatcaaagcataagt

SEQ ID NO: 968899 - DNA, 25 bp, Mus musculus
tttcctccatctatcttaggtctta

SEQ ID NO: 968900 - DNA, 25 bp, Mus musculus
tttcctccatctttcttaggtctta

SEQ ID NO: 968901 - DNA, 25 bp, Mus musculus
tttcctcccaaaacctacaacaagg

SEQ ID NO: 968902 - DNA, 25 bp, Mus musculus
tttcctcccaaatcctacaacaagg

SEQ ID NO: 968903 - DNA, 25 bp, Mus musculus
tttcctcccattagaatctgtctct

SEQ ID NO: 968904 - DNA, 25 bp, Mus musculus
tttcctcccatttgaatctgtctct

SEQ ID NO: 968905 - DNA, 25 bp, Mus musculus
tttcctccccaaattaatcttgtat

SEQ ID NO: 968906 - DNA, 25 bp, Mus musculus
tttcctccccaatttaatcttgtat

SEQ ID NO: 968907 - DNA, 25 bp, Mus musculus
tttcctcccctgcttaaaattgtag

SEQ ID NO: 968908 - DNA, 25 bp, Mus musculus
tttcctcccctggttaaaattgtag

SEQ ID NO: 968909 - DNA, 25 bp, Mus musculus
tttcctcccgggattagctcctctg

SEQ ID NO: 968910 - DNA, 25 bp, Mus musculus
tttcctcccgggtttagctcctctg

SEQ ID NO: 968911 - DNA, 25 bp, Mus musculus
tttcctccctaaatgctacgtgatt

SEQ ID NO: 968912 - DNA, 25 bp, Mus musculus
tttcctccctaattgctacgtgatt

SEQ ID NO: 968913 - DNA, 25 bp, Mus musculus
tttcctccctacatggctgacttgt

SEQ ID NO: 968914 - DNA, 25 bp, Mus musculus
tttcctccctacttggctgacttgt

SEQ ID NO: 968915 - DNA, 25 bp, Mus musculus
tttcctccctctcactgaataatta

SEQ ID NO: 968916 - DNA, 25 bp, Mus musculus
tttcctccctctgactgaataatta

SEQ ID NO: 968917 - DNA, 25 bp, Mus musculus
tttcctccgaatcggatgaatctgt

SEQ ID NO: 968918 - DNA, 25 bp, Mus musculus
tttcctccgaatgggatgaatctgt

SEQ ID NO: 968919 - DNA, 25 bp, Mus musculus
tttcctccgcatatatatactctgt

SEQ ID NO: 968920 - DNA, 25 bp, Mus musculus
tttcctccgcatttatatactctgt

SEQ ID NO: 968921 - DNA, 25 bp, Mus musculus
tttcctccgtggctactgtgaagat

SEQ ID NO: 968922 - DNA, 25 bp, Mus musculus
tttcctccgtgggtactgtgaagat

SEQ ID NO: 968923 - DNA, 25 bp, Mus musculus
tttcctcctacaatgagcagacacg

SEQ ID NO: 968924 - DNA, 25 bp, Mus musculus
tttcctcctacattgagcagacacg

SEQ ID NO: 968925 - DNA, 25 bp, Mus musculus
tttcctcctatgacaggattccaca

SEQ ID NO: 968926 - DNA, 25 bp, Mus musculus
tttcctcctatgtcaggattccaca

SEQ ID NO: 968927 - DNA, 25 bp, Mus musculus
tttcctcctcctctcatagtagctt

SEQ ID NO: 968928 - DNA, 25 bp, Mus musculus
tttcctcctcctgtcatagtagctt

SEQ ID NO: 968929 - DNA, 25 bp, Mus musculus
tttcctcctcttcctaggtctgaat

SEQ ID NO: 968930 - DNA, 25 bp, Mus musculus
tttcctcctcttgctaggtctgaat

SEQ ID NO: 968931 - DNA, 25 bp, Mus musculus
tttcctcctgagaactcatgttgct

SEQ ID NO: 968932 - DNA, 25 bp, Mus musculus
tttcctcctgagtactcatgttgct

SEQ ID NO: 968933 - DNA, 25 bp, Mus musculus
tttcctcctgctattagacattccg

SEQ ID NO: 968934 - DNA, 25 bp, Mus musculus
tttcctcctgcttttagacattccg

SEQ ID NO: 968935 - DNA, 25 bp, Mus musculus
tttcctccttctagattttgaggcg

SEQ ID NO: 968936 - DNA, 25 bp, Mus musculus
tttcctccttcttgattttgaggcg

SEQ ID NO: 968937 - DNA, 25 bp, Mus musculus
tttcctccttgtagaatgtcttcca

SEQ ID NO: 968938 - DNA, 25 bp, Mus musculus
tttcctccttgttgaatgtcttcca

SEQ ID NO: 968939 - DNA, 25 bp, Mus musculus
tttcctcctttaacaccagaggttg

SEQ ID NO: 968940 - DNA, 25 bp, Mus musculus
tttcctcctttatcaccagaggttg

SEQ ID NO: 968941 - DNA, 25 bp, Mus musculus
tttcctcgatgtctgctaaagcctt

SEQ ID NO: 968942 - DNA, 25 bp, Mus musculus
tttcctcgatgtgtgctaaagcctt

SEQ ID NO: 968943 - DNA, 25 bp, Mus musculus
tttcctcgcaagacagcagtgccaa

SEQ ID NO: 968944 - DNA, 25 bp, Mus musculus
tttcctcgcaagtcagcagtgccaa

SEQ ID NO: 968945 - DNA, 25 bp, Mus musculus
tttcctcgcacaaaatatcatgatt

SEQ ID NO: 968946 - DNA, 25 bp, Mus musculus
tttcctcgcacataatatcatgatt

SEQ ID NO: 968947 - DNA, 25 bp, Mus musculus
tttcctcggcctacagttccttgag

SEQ ID NO: 968948 - DNA, 25 bp, Mus musculus
tttcctcggccttcagttccttgag

SEQ ID NO: 968949 - DNA, 25 bp, Mus musculus
tttcctcggctaaacatatacctca

SEQ ID NO: 968950 - DNA, 25 bp, Mus musculus
tttcctcggctatacatatacctca

SEQ ID NO: 968951 - DNA, 25 bp, Mus musculus
tttcctcgggaaactctagctactt

SEQ ID NO: 968952 - DNA, 25 bp, Mus musculus
tttcctcgggaatctctagctactt

SEQ ID NO: 968953 - DNA, 25 bp, Mus musculus
tttcctcgtcatcgtgatttcctat

SEQ ID NO: 968954 - DNA, 25 bp, Mus musculus
tttcctcgtcatggtgatttcctat

SEQ ID NO: 968955 - DNA, 25 bp, Mus musculus
tttcctctacttaatggcctatgct

SEQ ID NO: 968956 - DNA, 25 bp, Mus musculus
tttcctctactttatggcctatgct

SEQ ID NO: 968957 - DNA, 25 bp, Mus musculus
tttcctctaggaacctgcaaaggta

SEQ ID NO: 968958 - DNA, 25 bp, Mus musculus
tttcctctaggaaggagctggcaga

SEQ ID NO: 968959 - DNA, 25 bp, Mus musculus
tttcctctaggatcctgcaaaggta

SEQ ID NO: 968960 - DNA, 25 bp, Mus musculus
tttcctctaggatggagctggcaga

SEQ ID NO: 968961 - DNA, 25 bp, Mus musculus
tttcctctattgatgccccttactg

SEQ ID NO: 968962 - DNA, 25 bp, Mus musculus
tttcctctattgttgccccttactg

SEQ ID NO: 968963 - DNA, 25 bp, Mus musculus
tttcctctcaatcggtgtgtacaca

SEQ ID NO: 968964 - DNA, 25 bp, Mus musculus
tttcctctcaatgggtgtgtacaca

SEQ ID NO: 968965 - DNA, 25 bp, Mus musculus
tttcctctcagaagattctggcagc

SEQ ID NO: 968966 - DNA, 25 bp, Mus musculus
tttcctctcagatgattctggcagc

SEQ ID NO: 968967 - DNA, 25 bp, Mus musculus
tttcctctccatcttatcttgggac

SEQ ID NO: 968968 - DNA, 25 bp, Mus musculus
tttcctctccatgttatcttgggac

SEQ ID NO: 968969 - DNA, 25 bp, Mus musculus
tttcctctctatacaaacttctgca

SEQ ID NO: 968970 - DNA, 25 bp, Mus musculus
tttcctctctatatcatgcaggtgt

SEQ ID NO: 968971 - DNA, 25 bp, Mus musculus
tttcctctctattcaaacttctgca

SEQ ID NO: 968972 - DNA, 25 bp, Mus musculus
tttcctctctatttcatgcaggtgt

SEQ ID NO: 968973 - DNA, 25 bp, Mus musculus
tttcctctcttcaattgtataccca

SEQ ID NO: 968974 - DNA, 25 bp, Mus musculus
tttcctctcttctattgtataccca

SEQ ID NO: 968975 - DNA, 25 bp, Mus musculus
tttcctctgactccctctatgtaag

SEQ ID NO: 968976 - DNA, 25 bp, Mus musculus
tttcctctgactgcctctatgtaag

SEQ ID NO: 968977 - DNA, 25 bp, Mus musculus
tttcctctgagcctgggccagtgta

SEQ ID NO: 968978 - DNA, 25 bp, Mus musculus
tttcctctgagcgtgggccagtgta

SEQ ID NO: 968979 - DNA, 25 bp, Mus musculus
tttcctctgagtcctacaggtctga

SEQ ID NO: 968980 - DNA, 25 bp, Mus musculus
tttcctctgagtctatccccttggt

SEQ ID NO: 968981 - DNA, 25 bp, Mus musculus
tttcctctgagtgctacaggtctga

SEQ ID NO: 968982 - DNA, 25 bp, Mus musculus
tttcctctgagtgtatccccttggt

SEQ ID NO: 968983 - DNA, 25 bp, Mus musculus
tttcctctgcacaaagcaagggctt

SEQ ID NO: 968984 - DNA, 25 bp, Mus musculus
tttcctctgcactaagcaagggctt

SEQ ID NO: 968985 - DNA, 25 bp, Mus musculus
tttcctctgctcaacatagttgggc

SEQ ID NO: 968986 - DNA, 25 bp, Mus musculus
tttcctctgctctacatagttgggc

SEQ ID NO: 968987 - DNA, 25 bp, Mus musculus
tttcctctgctgagcataagtacca

SEQ ID NO: 968988 - DNA, 25 bp, Mus musculus
tttcctctgctgtgcataagtacca

SEQ ID NO: 968989 - DNA, 25 bp, Mus musculus
tttcctctgcttagccagattggag

SEQ ID NO: 968990 - DNA, 25 bp, Mus musculus
tttcctctgctttgccagattggag

SEQ ID NO: 968991 - DNA, 25 bp, Mus musculus
tttcctctggaaagcgcatctgcgt

SEQ ID NO: 968992 - DNA, 25 bp, Mus musculus
tttcctctggaacatctctggatgt

SEQ ID NO: 968993 - DNA, 25 bp, Mus musculus
tttcctctggaacctcatgtttatt

SEQ ID NO: 968994 - DNA, 25 bp, Mus musculus
tttcctctggaagatctctggatgt

SEQ ID NO: 968995 - DNA, 25 bp, Mus musculus
tttcctctggaagctcatgtttatt

SEQ ID NO: 968996 - DNA, 25 bp, Mus musculus
tttcctctggaatgcgcatctgcgt

SEQ ID NO: 968997 - DNA, 25 bp, Mus musculus
tttcctctggacagtattttcctac

SEQ ID NO: 968998 - DNA, 25 bp, Mus musculus
tttcctctggactgtattttcctac

SEQ ID NO: 968999 - DNA, 25 bp, Mus musculus
tttcctctggatacaaccccatgag

SEQ ID NO: 969000 - DNA, 25 bp, Mus musculus
tttcctctggattcaaccccatgag

SEQ ID NO: 969001 - DNA, 25 bp, Mus musculus
tttcctctggctaggctatatcaat

SEQ ID NO: 969002 - DNA, 25 bp, Mus musculus
tttcctctggcttggctatatcaat

SEQ ID NO: 969003 - DNA, 25 bp, Mus musculus
tttcctctgttaatttgctatgctt

SEQ ID NO: 969004 - DNA, 25 bp, Mus musculus
tttcctctgttattttgctatgctt

SEQ ID NO: 969005 - DNA, 25 bp, Mus musculus
tttcctctgtttatctctggctagt

SEQ ID NO: 969006 - DNA, 25 bp, Mus musculus
tttcctctgtttttctctggctagt

SEQ ID NO: 969007 - DNA, 25 bp, Mus musculus
tttcctcttactctgattttccttt

SEQ ID NO: 969008 - DNA, 25 bp, Mus musculus
tttcctcttactgtgattttccttt

SEQ ID NO: 969009 - DNA, 25 bp, Mus musculus
tttcctcttcgtcacggaactttag

SEQ ID NO: 969010 - DNA, 25 bp, Mus musculus
tttcctcttcgtgacggaactttag

SEQ ID NO: 969011 - DNA, 25 bp, Mus musculus
tttcctcttctcaaaactaacctgg

SEQ ID NO: 969012 - DNA, 25 bp, Mus musculus
tttcctcttctctaaactaacctgg

SEQ ID NO: 969013 - DNA, 25 bp, Mus musculus
tttcctctttccattcgtcatctca

SEQ ID NO: 969014 - DNA, 25 bp, Mus musculus
tttcctctttcctttcgtcatctca

SEQ ID NO: 969015 - DNA, 25 bp, Mus musculus
tttcctcttttcagtagtaccattg

SEQ ID NO: 969016 - DNA, 25 bp, Mus musculus
tttcctcttttctgtagtaccattg

SEQ ID NO: 969017 - DNA, 25 bp, Mus musculus
tttcctctttttaccaagtggtgag

SEQ ID NO: 969018 - DNA, 25 bp, Mus musculus
tttcctcttttttccaagtggtgag

SEQ ID NO: 969019 - DNA, 25 bp, Mus musculus
tttcctgaaagccaaaatcgttgag

SEQ ID NO: 969020 - DNA, 25 bp, Mus musculus
tttcctgaaagcgaaaatcgttgag

SEQ ID NO: 969021 - DNA, 25 bp, Mus musculus
tttcctgaagtccattgcttcctga

SEQ ID NO: 969022 - DNA, 25 bp, Mus musculus
tttcctgaagtcgattgcttcctga

SEQ ID NO: 969023 - DNA, 25 bp, Mus musculus
tttcctgaagttaaatgctgggcca

SEQ ID NO: 969024 - DNA, 25 bp, Mus musculus
tttcctgaagtttaatgctgggcca

SEQ ID NO: 969025 - DNA, 25 bp, Mus musculus
tttcctgaatgcagtatggttggtg

SEQ ID NO: 969026 - DNA, 25 bp, Mus musculus
tttcctgaatgctgtatggttggtg

SEQ ID NO: 969027 - DNA, 25 bp, Mus musculus
tttcctgaattgcacatgtgtttac

SEQ ID NO: 969028 - DNA, 25 bp, Mus musculus
tttcctgaattggacatgtgtttac

SEQ ID NO: 969029 - DNA, 25 bp, Mus musculus
tttcctgaatttctacgccgtcttg

SEQ ID NO: 969030 - DNA, 25 bp, Mus musculus
tttcctgaatttgtacgccgtcttg

SEQ ID NO: 969031 - DNA, 25 bp, Mus musculus
tttcctgacaccaagggctttctga

SEQ ID NO: 969032 - DNA, 25 bp, Mus musculus
tttcctgacacctagggctttctga

SEQ ID NO: 969033 - DNA, 25 bp, Mus musculus
tttcctgacccactgatatgtcaag

SEQ ID NO: 969034 - DNA, 25 bp, Mus musculus
tttcctgacccagtgatatgtcaag

SEQ ID NO: 969035 - DNA, 25 bp, Mus musculus
tttcctgactccaggcatgaagcag

SEQ ID NO: 969036 - DNA, 25 bp, Mus musculus
tttcctgactcctggcatgaagcag

SEQ ID NO: 969037 - DNA, 25 bp, Mus musculus
tttcctgactcgctgtatggatctg

SEQ ID NO: 969038 - DNA, 25 bp, Mus musculus
tttcctgactcggtgtatggatctg

SEQ ID NO: 969039 - DNA, 25 bp, Mus musculus
tttcctgagaggatggagtgccatt

SEQ ID NO: 969040 - DNA, 25 bp, Mus musculus
tttcctgagaggttggagtgccatt

SEQ ID NO: 969041 - DNA, 25 bp, Mus musculus
tttcctgagatgatgttagcactac

SEQ ID NO: 969042 - DNA, 25 bp, Mus musculus
tttcctgagatgttgttagcactac

SEQ ID NO: 969043 - DNA, 25 bp, Mus musculus
tttcctgaggacaacaaccgtggcc

SEQ ID NO: 969044 - DNA, 25 bp, Mus musculus
tttcctgaggactacaaccgtggcc

SEQ ID NO: 969045 - DNA, 25 bp, Mus musculus
tttcctgaggagatccctggctgca

SEQ ID NO: 969046 - DNA, 25 bp, Mus musculus
tttcctgaggagttccctggctgca

SEQ ID NO: 969047 - DNA, 25 bp, Mus musculus
tttcctgaggatccattgagcgctt

SEQ ID NO: 969048 - DNA, 25 bp, Mus musculus
tttcctgaggatgcattgagcgctt

SEQ ID NO: 969049 - DNA, 25 bp, Mus musculus
tttcctgagggtcacagaggatgca

SEQ ID NO: 969050 - DNA, 25 bp, Mus musculus
tttcctgagggtgacagaggatgca

SEQ ID NO: 969051 - DNA, 25 bp, Mus musculus
tttcctgagtctacagcagcggctc

SEQ ID NO: 969052 - DNA, 25 bp, Mus musculus
tttcctgagtcttcagcagcggctc

SEQ ID NO: 969053 - DNA, 25 bp, Mus musculus
tttcctgagtggctgagtcggaccc

SEQ ID NO: 969054 - DNA, 25 bp, Mus musculus
tttcctgagtgggtgagtcggaccc

SEQ ID NO: 969055 - DNA, 25 bp, Mus musculus
tttcctgagttccacgatagcctac

SEQ ID NO: 969056 - DNA, 25 bp, Mus musculus
tttcctgagttcgacgatagcctac

SEQ ID NO: 969057 - DNA, 25 bp, Mus musculus
tttcctgatagcatttccgcttgtt

SEQ ID NO: 969058 - DNA, 25 bp, Mus musculus
tttcctgatagcttttccgcttgtt

SEQ ID NO: 969059 - DNA, 25 bp, Mus musculus
tttcctgatctaactatgtttcccc

SEQ ID NO: 969060 - DNA, 25 bp, Mus musculus
tttcctgatctatctatgtttcccc

SEQ ID NO: 969061 - DNA, 25 bp, Mus musculus
tttcctgatgcaaaagttacctctg

SEQ ID NO: 969062 - DNA, 25 bp, Mus musculus
tttcctgatgcataagttacctctg

SEQ ID NO: 969063 - DNA, 25 bp, Mus musculus
tttcctgattccatacccgttgttg

SEQ ID NO: 969064 - DNA, 25 bp, Mus musculus
tttcctgattccttacccgttgttg

SEQ ID NO: 969065 - DNA, 25 bp, Mus musculus
tttcctgattgaagcttcgtggatg

SEQ ID NO: 969066 - DNA, 25 bp, Mus musculus
tttcctgattgatgcttcgtggatg

SEQ ID NO: 969067 - DNA, 25 bp, Mus musculus
tttcctgcactcacaagacttactt

SEQ ID NO: 969068 - DNA, 25 bp, Mus musculus
tttcctgcactctcaagacttactt

SEQ ID NO: 969069 - DNA, 25 bp, Mus musculus
tttcctgcacttcgatcaatcactc

SEQ ID NO: 969070 - DNA, 25 bp, Mus musculus
tttcctgcacttggatcaatcactc

SEQ ID NO: 969071 - DNA, 25 bp, Mus musculus
tttcctgcaggtatactctggtttc

SEQ ID NO: 969072 - DNA, 25 bp, Mus musculus
tttcctgcaggtttactctggtttc

SEQ ID NO: 969073 - DNA, 25 bp, Mus musculus
tttcctgcatccacacaaagaatga

SEQ ID NO: 969074 - DNA, 25 bp, Mus musculus
tttcctgcatcctcacaaagaatga

SEQ ID NO: 969075 - DNA, 25 bp, Mus musculus
tttcctgcatctcccaagtactgga

SEQ ID NO: 969076 - DNA, 25 bp, Mus musculus
tttcctgcatctgccaagtactgga

SEQ ID NO: 969077 - DNA, 25 bp, Mus musculus
tttcctgcatgactttccttagttc

SEQ ID NO: 969078 - DNA, 25 bp, Mus musculus
tttcctgcatgagtttccttagttc

SEQ ID NO: 969079 - DNA, 25 bp, Mus musculus
tttcctgcatggcaacatctttcat

SEQ ID NO: 969080 - DNA, 25 bp, Mus musculus
tttcctgcatggctcacagaggtga

SEQ ID NO: 969081 - DNA, 25 bp, Mus musculus
tttcctgcatgggaacatctttcat

SEQ ID NO: 969082 - DNA, 25 bp, Mus musculus
tttcctgcatgggtcacagaggtga

SEQ ID NO: 969083 - DNA, 25 bp, Mus musculus
tttcctgcatttaggattgacctga

SEQ ID NO: 969084 - DNA, 25 bp, Mus musculus
tttcctgcattttggattgacctga

SEQ ID NO: 969085 - DNA, 25 bp, Mus musculus
tttcctgccactctggtgagacaga

SEQ ID NO: 969086 - DNA, 25 bp, Mus musculus
tttcctgccactgtggtgagacaga

SEQ ID NO: 969087 - DNA, 25 bp, Mus musculus
tttcctgcccagaagaggcttgttt

SEQ ID NO: 969088 - DNA, 25 bp, Mus musculus
tttcctgcccagtagaggcttgttt

SEQ ID NO: 969089 - DNA, 25 bp, Mus musculus
tttcctgccccaaccggataagtgc

SEQ ID NO: 969090 - DNA, 25 bp, Mus musculus
tttcctgccccatccggataagtgc

SEQ ID NO: 969091 - DNA, 25 bp, Mus musculus
tttcctgcccgaaggccattaaaaa

SEQ ID NO: 969092 - DNA, 25 bp, Mus musculus
tttcctgcccgatggccattaaaaa

SEQ ID NO: 969093 - DNA, 25 bp, Mus musculus
tttcctgccctgaaagataaaagtt

SEQ ID NO: 969094 - DNA, 25 bp, Mus musculus
tttcctgccctgtaagataaaagtt

SEQ ID NO: 969095 - DNA, 25 bp, Mus musculus
tttcctgccgtgaacagcctgatac

SEQ ID NO: 969096 - DNA, 25 bp, Mus musculus
tttcctgccgtgtacagcctgatac

SEQ ID NO: 969097 - DNA, 25 bp, Mus musculus
tttcctgcctcaagatcaatcaatc

SEQ ID NO: 969098 - DNA, 25 bp, Mus musculus
tttcctgcctcatgatcaatcaatc

SEQ ID NO: 969099 - DNA, 25 bp, Mus musculus
tttcctgcctggataatatccgcta

SEQ ID NO: 969100 - DNA, 25 bp, Mus musculus
tttcctgcctggttaatatccgcta

SEQ ID NO: 969101 - DNA, 25 bp, Mus musculus
tttcctgccttacatctctgtctta

SEQ ID NO: 969102 - DNA, 25 bp, Mus musculus
tttcctgccttagatctctgtctta

SEQ ID NO: 969103 - DNA, 25 bp, Mus musculus
tttcctgcgactctctttgttttta

SEQ ID NO: 969104 - DNA, 25 bp, Mus musculus
tttcctgcgactgtctttgttttta

SEQ ID NO: 969105 - DNA, 25 bp, Mus musculus
tttcctgcggtgcatccttggatcg

SEQ ID NO: 969106 - DNA, 25 bp, Mus musculus
tttcctgcggtggatccttggatcg

SEQ ID NO: 969107 - DNA, 25 bp, Mus musculus
tttcctgctaataccttcaccaata

SEQ ID NO: 969108 - DNA, 25 bp, Mus musculus
tttcctgctaattccttcaccaata

SEQ ID NO: 969109 - DNA, 25 bp, Mus musculus
tttcctgctcacaatgagtggcctt

SEQ ID NO: 969110 - DNA, 25 bp, Mus musculus
tttcctgctcactatgagtggcctt

SEQ ID NO: 969111 - DNA, 25 bp, Mus musculus
tttcctgctcctcgaaacagggagt

SEQ ID NO: 969112 - DNA, 25 bp, Mus musculus
tttcctgctcctggaaacagggagt

SEQ ID NO: 969113 - DNA, 25 bp, Mus musculus
tttcctgctcgcagaaacgaacatg

SEQ ID NO: 969114 - DNA, 25 bp, Mus musculus
tttcctgctcgctgaaacgaacatg

SEQ ID NO: 969115 - DNA, 25 bp, Mus musculus
tttcctgctcttcagcaaagccaag

SEQ ID NO: 969116 - DNA, 25 bp, Mus musculus
tttcctgctcttgagcaaagccaag

SEQ ID NO: 969117 - DNA, 25 bp, Mus musculus
tttcctgctgaaaccggctgaagat

SEQ ID NO: 969118 - DNA, 25 bp, Mus musculus
tttcctgctgaatccggctgaagat

SEQ ID NO: 969119 - DNA, 25 bp, Mus musculus
tttcctgctgccatttcccaaagtg

SEQ ID NO: 969120 - DNA, 25 bp, Mus musculus
tttcctgctgccttttcccaaagtg

SEQ ID NO: 969121 - DNA, 25 bp, Mus musculus
tttcctgctgctcatttattggtgt

SEQ ID NO: 969122 - DNA, 25 bp, Mus musculus
tttcctgctgctgatttattggtgt

SEQ ID NO: 969123 - DNA, 25 bp, Mus musculus
tttcctgctggcattctgtagtaga

SEQ ID NO: 969124 - DNA, 25 bp, Mus musculus
tttcctgctggctttctgtagtaga

SEQ ID NO: 969125 - DNA, 25 bp, Mus musculus
tttcctgctggtatgatacaaggtc

SEQ ID NO: 969126 - DNA, 25 bp, Mus musculus
tttcctgctggtttgatacaaggtc

SEQ ID NO: 969127 - DNA, 25 bp, Mus musculus
tttcctgctgtcactaactatagag

SEQ ID NO: 969128 - DNA, 25 bp, Mus musculus
tttcctgctgtctctaactatagag

SEQ ID NO: 969129 - DNA, 25 bp, Mus musculus
tttcctgcttcaacttgtgtttatt

SEQ ID NO: 969130 - DNA, 25 bp, Mus musculus
tttcctgcttcatcttgtgtttatt

SEQ ID NO: 969131 - DNA, 25 bp, Mus musculus
tttcctgcttctaagacttccatct

SEQ ID NO: 969132 - DNA, 25 bp, Mus musculus
tttcctgcttcttagacttccatct

SEQ ID NO: 969133 - DNA, 25 bp, Mus musculus
tttcctgcttggcatccagttaaat

SEQ ID NO: 969134 - DNA, 25 bp, Mus musculus
tttcctgcttgggatccagttaaat

SEQ ID NO: 969135 - DNA, 25 bp, Mus musculus
tttcctggacgcacatgcttatgca

SEQ ID NO: 969136 - DNA, 25 bp, Mus musculus
tttcctggacgctcatgcttatgca

SEQ ID NO: 969137 - DNA, 25 bp, Mus musculus
tttcctggagccatctctgacaaga

SEQ ID NO: 969138 - DNA, 25 bp, Mus musculus
tttcctggagccttctctgacaaga

SEQ ID NO: 969139 - DNA, 25 bp, Mus musculus
tttcctggagtcaaacagttcttgg

SEQ ID NO: 969140 - DNA, 25 bp, Mus musculus
tttcctggagtcctctagtgacaaa

SEQ ID NO: 969141 - DNA, 25 bp, Mus musculus
tttcctggagtcgtctagtgacaaa

SEQ ID NO: 969142 - DNA, 25 bp, Mus musculus
tttcctggagtctaacagttcttgg

SEQ ID NO: 969143 - DNA, 25 bp, Mus musculus
tttcctggatgtccccttatgcaaa

SEQ ID NO: 969144 - DNA, 25 bp, Mus musculus
tttcctggatgtgcccttatgcaaa

SEQ ID NO: 969145 - DNA, 25 bp, Mus musculus
tttcctggattgcttaggtatcaat

SEQ ID NO: 969146 - DNA, 25 bp, Mus musculus
tttcctggattggttaggtatcaat

SEQ ID NO: 969147 - DNA, 25 bp, Mus musculus
tttcctggcaaactagagtatcatg

SEQ ID NO: 969148 - DNA, 25 bp, Mus musculus
tttcctggcaaagtagagtatcatg

SEQ ID NO: 969149 - DNA, 25 bp, Mus musculus
tttcctggccaacaggtctacatgg

SEQ ID NO: 969150 - DNA, 25 bp, Mus musculus
tttcctggccaagaggtctacatgg

SEQ ID NO: 969151 - DNA, 25 bp, Mus musculus
tttcctggccccacaaaagataaat

SEQ ID NO: 969152 - DNA, 25 bp, Mus musculus
tttcctggcccctcaaaagataaat

SEQ ID NO: 969153 - DNA, 25 bp, Mus musculus
tttcctggcttcatggtataaaaag

SEQ ID NO: 969154 - DNA, 25 bp, Mus musculus
tttcctggcttcctgttgacaagtg

SEQ ID NO: 969155 - DNA, 25 bp, Mus musculus
tttcctggcttcgtgttgacaagtg

SEQ ID NO: 969156 - DNA, 25 bp, Mus musculus
tttcctggcttcttggtataaaaag

SEQ ID NO: 969157 - DNA, 25 bp, Mus musculus
tttcctggctttcaacagaggctct

SEQ ID NO: 969158 - DNA, 25 bp, Mus musculus
tttcctggctttcgtaactaccctg

SEQ ID NO: 969159 - DNA, 25 bp, Mus musculus
tttcctggctttgaacagaggctct

SEQ ID NO: 969160 - DNA, 25 bp, Mus musculus
tttcctggctttggtaactaccctg

SEQ ID NO: 969161 - DNA, 25 bp, Mus musculus
tttcctgggaacactgtagctcaga

SEQ ID NO: 969162 - DNA, 25 bp, Mus musculus
tttcctgggaactctgtagctcaga

SEQ ID NO: 969163 - DNA, 25 bp, Mus musculus
tttcctgggaagcagaatcacctgc

SEQ ID NO: 969164 - DNA, 25 bp, Mus musculus
tttcctgggaagctctaagatgtaa

SEQ ID NO: 969165 - DNA, 25 bp, Mus musculus
tttcctgggaaggagaatcacctgc

SEQ ID NO: 969166 - DNA, 25 bp, Mus musculus
tttcctgggaaggtctaagatgtaa

SEQ ID NO: 969167 - DNA, 25 bp, Mus musculus
tttcctgggaataccctgttgcagt

SEQ ID NO: 969168 - DNA, 25 bp, Mus musculus
tttcctgggaattccctgttgcagt

SEQ ID NO: 969169 - DNA, 25 bp, Mus musculus
tttcctgggaccatgctactggaat

SEQ ID NO: 969170 - DNA, 25 bp, Mus musculus
tttcctgggaccttgctactggaat

SEQ ID NO: 969171 - DNA, 25 bp, Mus musculus
tttcctgggcacactaaaggcagag

SEQ ID NO: 969172 - DNA, 25 bp, Mus musculus
tttcctgggcactctaaaggcagag

SEQ ID NO: 969173 - DNA, 25 bp, Mus musculus
tttcctgggctcaattgggcacaaa

SEQ ID NO: 969174 - DNA, 25 bp, Mus musculus
tttcctgggctctattgggcacaaa

SEQ ID NO: 969175 - DNA, 25 bp, Mus musculus
tttcctgggcttcttgacagccaca

SEQ ID NO: 969176 - DNA, 25 bp, Mus musculus
tttcctgggcttgttgacagccaca

SEQ ID NO: 969177 - DNA, 25 bp, Mus musculus
tttcctgggtggcatcatggtagtt

SEQ ID NO: 969178 - DNA, 25 bp, Mus musculus
tttcctgggtgggatcatggtagtt

SEQ ID NO: 969179 - DNA, 25 bp, Mus musculus
tttcctggtagactaatggcagcca

SEQ ID NO: 969180 - DNA, 25 bp, Mus musculus
tttcctggtagagtaatggcagcca

SEQ ID NO: 969181 - DNA, 25 bp, Mus musculus
tttcctggtcaacgtcatggcctca

SEQ ID NO: 969182 - DNA, 25 bp, Mus musculus
tttcctggtcaactaaactactgtg

SEQ ID NO: 969183 - DNA, 25 bp, Mus musculus
tttcctggtcaaggtcatggcctca

SEQ ID NO: 969184 - DNA, 25 bp, Mus musculus
tttcctggtcaagtaaactactgtg

SEQ ID NO: 969185 - DNA, 25 bp, Mus musculus
tttcctggtcatacaaatctgtgtc

SEQ ID NO: 969186 - DNA, 25 bp, Mus musculus
tttcctggtcatactctcttcagac

SEQ ID NO: 969187 - DNA, 25 bp, Mus musculus
tttcctggtcattcaaatctgtgtc

SEQ ID NO: 969188 - DNA, 25 bp, Mus musculus
tttcctggtcattctctcttcagac

SEQ ID NO: 969189 - DNA, 25 bp, Mus musculus
tttcctggtccaccgttttaaacag

SEQ ID NO: 969190 - DNA, 25 bp, Mus musculus
tttcctggtccagcgttttaaacag

SEQ ID NO: 969191 - DNA, 25 bp, Mus musculus
tttcctggtctcaggaggcctaaca

SEQ ID NO: 969192 - DNA, 25 bp, Mus musculus
tttcctggtctctggaggcctaaca

SEQ ID NO: 969193 - DNA, 25 bp, Mus musculus
tttcctggtgccagtgatgggctat

SEQ ID NO: 969194 - DNA, 25 bp, Mus musculus
tttcctggtgcctgtgatgggctat

SEQ ID NO: 969195 - DNA, 25 bp, Mus musculus
tttcctggttggagggacagcccca

SEQ ID NO: 969196 - DNA, 25 bp, Mus musculus
tttcctggttggtgggacagcccca

SEQ ID NO: 969197 - DNA, 25 bp, Mus musculus
tttcctgtaactatgcccacatttg

SEQ ID NO: 969198 - DNA, 25 bp, Mus musculus
tttcctgtaactccccaagaattct

SEQ ID NO: 969199 - DNA, 25 bp, Mus musculus
tttcctgtaactgcccaagaattct

SEQ ID NO: 969200 - DNA, 25 bp, Mus musculus
tttcctgtaactttgcccacatttg

SEQ ID NO: 969201 - DNA, 25 bp, Mus musculus
tttcctgtaaggatgcccgtgagtg

SEQ ID NO: 969202 - DNA, 25 bp, Mus musculus
tttcctgtaaggttgcccgtgagtg

SEQ ID NO: 969203 - DNA, 25 bp, Mus musculus
tttcctgtacacacagcgatggctg

SEQ ID NO: 969204 - DNA, 25 bp, Mus musculus
tttcctgtacacattccttcagcag

SEQ ID NO: 969205 - DNA, 25 bp, Mus musculus
tttcctgtacactcagcgatggctg

SEQ ID NO: 969206 - DNA, 25 bp, Mus musculus
tttcctgtacactttccttcagcag

SEQ ID NO: 969207 - DNA, 25 bp, Mus musculus
tttcctgtacctatgctctcagagt

SEQ ID NO: 969208 - DNA, 25 bp, Mus musculus
tttcctgtacctttgctctcagagt

SEQ ID NO: 969209 - DNA, 25 bp, Mus musculus
tttcctgtactgctgatgtttcttt

SEQ ID NO: 969210 - DNA, 25 bp, Mus musculus
tttcctgtactggtgatgtttcttt

SEQ ID NO: 969211 - DNA, 25 bp, Mus musculus
tttcctgtagggactgtttcagcat

SEQ ID NO: 969212 - DNA, 25 bp, Mus musculus
tttcctgtagggtctgtttcagcat

SEQ ID NO: 969213 - DNA, 25 bp, Mus musculus
tttcctgtagttaatgtgcaggtat

SEQ ID NO: 969214 - DNA, 25 bp, Mus musculus
tttcctgtagtttatgtgcaggtat

SEQ ID NO: 969215 - DNA, 25 bp, Mus musculus
tttcctgtatctctttgatgccaga

SEQ ID NO: 969216 - DNA, 25 bp, Mus musculus
tttcctgtatctgtttgatgccaga

SEQ ID NO: 969217 - DNA, 25 bp, Mus musculus
tttcctgtatgcagtgggtggccat

SEQ ID NO: 969218 - DNA, 25 bp, Mus musculus
tttcctgtatgctgtgggtggccat

SEQ ID NO: 969219 - DNA, 25 bp, Mus musculus
tttcctgtatgtcttgctagtgcga

SEQ ID NO: 969220 - DNA, 25 bp, Mus musculus
tttcctgtatgtgttgctagtgcga

SEQ ID NO: 969221 - DNA, 25 bp, Mus musculus
tttcctgtcaaaccacaccctatgt

SEQ ID NO: 969222 - DNA, 25 bp, Mus musculus
tttcctgtcaaagcacaccctatgt

SEQ ID NO: 969223 - DNA, 25 bp, Mus musculus
tttcctgtcaatatgtcggtaccct

SEQ ID NO: 969224 - DNA, 25 bp, Mus musculus
tttcctgtcaatttgtcggtaccct

SEQ ID NO: 969225 - DNA, 25 bp, Mus musculus
tttcctgtcatacagcagaagccca

SEQ ID NO: 969226 - DNA, 25 bp, Mus musculus
tttcctgtcatagagcagaagccca

SEQ ID NO: 969227 - DNA, 25 bp, Mus musculus
tttcctgtcattccatgaaccttcc

SEQ ID NO: 969228 - DNA, 25 bp, Mus musculus
tttcctgtcattgcatgaaccttcc

SEQ ID NO: 969229 - DNA, 25 bp, Mus musculus
tttcctgtccagaaagaagccttga

SEQ ID NO: 969230 - DNA, 25 bp, Mus musculus
tttcctgtccagtaagaagccttga

SEQ ID NO: 969231 - DNA, 25 bp, Mus musculus
tttcctgtccccagaggctaaaagg

SEQ ID NO: 969232 - DNA, 25 bp, Mus musculus
tttcctgtcccctgaggctaaaagg

SEQ ID NO: 969233 - DNA, 25 bp, Mus musculus
tttcctgtcctcacaaacacctgga

SEQ ID NO: 969234 - DNA, 25 bp, Mus musculus
tttcctgtcctctcaaacacctgga

SEQ ID NO: 969235 - DNA, 25 bp, Mus musculus
tttcctgtcggacaagctgctcaac

SEQ ID NO: 969236 - DNA, 25 bp, Mus musculus
tttcctgtcggagaagctgctcaac

SEQ ID NO: 969237 - DNA, 25 bp, Mus musculus
tttcctgtctacctgtgtgttctct

SEQ ID NO: 969238 - DNA, 25 bp, Mus musculus
tttcctgtctacgtgtgtgttctct

SEQ ID NO: 969239 - DNA, 25 bp, Mus musculus
tttcctgtgaacatactcctgcaag

SEQ ID NO: 969240 - DNA, 25 bp, Mus musculus
tttcctgtgaacttactcctgcaag

SEQ ID NO: 969241 - DNA, 25 bp, Mus musculus
tttcctgtgagcaaggattacggac

SEQ ID NO: 969242 - DNA, 25 bp, Mus musculus
tttcctgtgagctaggattacggac

SEQ ID NO: 969243 - DNA, 25 bp, Mus musculus
tttcctgtgaggcttgtagacgttc

SEQ ID NO: 969244 - DNA, 25 bp, Mus musculus
tttcctgtgagggttgtagacgttc

SEQ ID NO: 969245 - DNA, 25 bp, Mus musculus
tttcctgtggtaagaaaccctgagc

SEQ ID NO: 969246 - DNA, 25 bp, Mus musculus
tttcctgtggtatgaaaccctgagc

SEQ ID NO: 969247 - DNA, 25 bp, Mus musculus
tttcctgtggtcctataacccaggt

SEQ ID NO: 969248 - DNA, 25 bp, Mus musculus
tttcctgtggtcgtataacccaggt

SEQ ID NO: 969249 - DNA, 25 bp, Mus musculus
tttcctgtggttaagggtcagtctt

SEQ ID NO: 969250 - DNA, 25 bp, Mus musculus
tttcctgtggtttagggtcagtctt

SEQ ID NO: 969251 - DNA, 25 bp, Mus musculus
tttcctgtgtgaaccgggatgcaga

SEQ ID NO: 969252 - DNA, 25 bp, Mus musculus
tttcctgtgtgatccgggatgcaga

SEQ ID NO: 969253 - DNA, 25 bp, Mus musculus
tttcctgtgttccaaaacctggtct

SEQ ID NO: 969254 - DNA, 25 bp, Mus musculus
tttcctgtgttcgaaaacctggtct

SEQ ID NO: 969255 - DNA, 25 bp, Mus musculus
tttcctgtgttgatgaccctacgga

SEQ ID NO: 969256 - DNA, 25 bp, Mus musculus
tttcctgtgttgttgaccctacgga

SEQ ID NO: 969257 - DNA, 25 bp, Mus musculus
tttcctgttagtcttctttgatccc

SEQ ID NO: 969258 - DNA, 25 bp, Mus musculus
tttcctgttagtgttctttgatccc

SEQ ID NO: 969259 - DNA, 25 bp, Mus musculus
tttcctgttatgaacctagtgttag

SEQ ID NO: 969260 - DNA, 25 bp, Mus musculus
tttcctgttatgtacctagtgttag

SEQ ID NO: 969261 - DNA, 25 bp, Mus musculus
tttcctgttcaaagtgatggtttca

SEQ ID NO: 969262 - DNA, 25 bp, Mus musculus
tttcctgttcaatgtgatggtttca

SEQ ID NO: 969263 - DNA, 25 bp, Mus musculus
tttcctgttctgctctatttgatac

SEQ ID NO: 969264 - DNA, 25 bp, Mus musculus
tttcctgttctggtctatttgatac

SEQ ID NO: 969265 - DNA, 25 bp, Mus musculus
tttcctgttgggaacttaagtgcac

SEQ ID NO: 969266 - DNA, 25 bp, Mus musculus
tttcctgttgggtacttaagtgcac

SEQ ID NO: 969267 - DNA, 25 bp, Mus musculus
tttcctgttggtcgagctttctttc

SEQ ID NO: 969268 - DNA, 25 bp, Mus musculus
tttcctgttggtggagctttctttc

SEQ ID NO: 969269 - DNA, 25 bp, Mus musculus
tttcctgtttatctcctgccagtga

SEQ ID NO: 969270 - DNA, 25 bp, Mus musculus
tttcctgtttatgtcctgccagtga

SEQ ID NO: 969271 - DNA, 25 bp, Mus musculus
tttcctgtttctaggctgaagatga

SEQ ID NO: 969272 - DNA, 25 bp, Mus musculus
tttcctgtttcttggctgaagatga

SEQ ID NO: 969273 - DNA, 25 bp, Mus musculus
tttcctgttttcacatagcaagcat

SEQ ID NO: 969274 - DNA, 25 bp, Mus musculus
tttcctgttttctcatagcaagcat

SEQ ID NO: 969275 - DNA, 25 bp, Mus musculus
tttcctgttttgagtcttctcttcc

SEQ ID NO: 969276 - DNA, 25 bp, Mus musculus
tttcctgttttgtgtcttctcttcc

SEQ ID NO: 969277 - DNA, 25 bp, Mus musculus
tttcctgtttttagatgctctctga

SEQ ID NO: 969278 - DNA, 25 bp, Mus musculus
tttcctgttttttgatgctctctga

SEQ ID NO: 969279 - DNA, 25 bp, Mus musculus
tttccttaacatcgtgggtgagtag

SEQ ID NO: 969280 - DNA, 25 bp, Mus musculus
tttccttaacatggtgggtgagtag

SEQ ID NO: 969281 - DNA, 25 bp, Mus musculus
tttccttaactgaatgtatgtccct

SEQ ID NO: 969282 - DNA, 25 bp, Mus musculus
tttccttaactgtatgtatgtccct

SEQ ID NO: 969283 - DNA, 25 bp, Mus musculus
tttccttaatctaaaagctctattc

SEQ ID NO: 969284 - DNA, 25 bp, Mus musculus
tttccttaatcttaaagctctattc

SEQ ID NO: 969285 - DNA, 25 bp, Mus musculus
tttccttacccaatttcttgccatt

SEQ ID NO: 969286 - DNA, 25 bp, Mus musculus
tttccttacccattttcttgccatt

SEQ ID NO: 969287 - DNA, 25 bp, Mus musculus
tttccttacctcaatgtgccatacg

SEQ ID NO: 969288 - DNA, 25 bp, Mus musculus
tttccttacctctatgtgccatacg

SEQ ID NO: 969289 - DNA, 25 bp, Mus musculus
tttccttactatccttgcttttcta

SEQ ID NO: 969290 - DNA, 25 bp, Mus musculus
tttccttactatgcttgcttttcta

SEQ ID NO: 969291 - DNA, 25 bp, Mus musculus
tttccttactccacgtatttgtacg

SEQ ID NO: 969292 - DNA, 25 bp, Mus musculus
tttccttactcctcgtatttgtacg

SEQ ID NO: 969293 - DNA, 25 bp, Mus musculus
tttccttactgcaaactcctaatga

SEQ ID NO: 969294 - DNA, 25 bp, Mus musculus
tttccttactgcatttcctcctgtg

SEQ ID NO: 969295 - DNA, 25 bp, Mus musculus
tttccttactgctaactcctaatga

SEQ ID NO: 969296 - DNA, 25 bp, Mus musculus
tttccttactgcttttcctcctgtg

SEQ ID NO: 969297 - DNA, 25 bp, Mus musculus
tttccttagcatatttatcccagtg

SEQ ID NO: 969298 - DNA, 25 bp, Mus musculus
tttccttagcatttttatcccagtg

SEQ ID NO: 969299 - DNA, 25 bp, Mus musculus
tttccttagctcacttggattctcc

SEQ ID NO: 969300 - DNA, 25 bp, Mus musculus
tttccttagctctcttggattctcc

SEQ ID NO: 969301 - DNA, 25 bp, Mus musculus
tttccttaggaaaatctccatttgg

SEQ ID NO: 969302 - DNA, 25 bp, Mus musculus
tttccttaggaatatctccatttgg

SEQ ID NO: 969303 - DNA, 25 bp, Mus musculus
tttccttatagccatgtagtcttta

SEQ ID NO: 969304 - DNA, 25 bp, Mus musculus
tttccttatagcgatgtagtcttta

SEQ ID NO: 969305 - DNA, 25 bp, Mus musculus
tttccttatattacaatagggtctt

SEQ ID NO: 969306 - DNA, 25 bp, Mus musculus
tttccttatatttcaatagggtctt

SEQ ID NO: 969307 - DNA, 25 bp, Mus musculus
tttccttatctgaggtctactgtga

SEQ ID NO: 969308 - DNA, 25 bp, Mus musculus
tttccttatctgtggtctactgtga

SEQ ID NO: 969309 - DNA, 25 bp, Mus musculus
tttccttatcttatctagtttctag

SEQ ID NO: 969310 - DNA, 25 bp, Mus musculus
tttccttatcttttctagtttctag

SEQ ID NO: 969311 - DNA, 25 bp, Mus musculus
tttccttatgctagaaatgctccac

SEQ ID NO: 969312 - DNA, 25 bp, Mus musculus
tttccttatgcttgaaatgctccac

SEQ ID NO: 969313 - DNA, 25 bp, Mus musculus
tttccttatggcattctcaagcgcc

SEQ ID NO: 969314 - DNA, 25 bp, Mus musculus
tttccttatggctttctcaagcgcc

SEQ ID NO: 969315 - DNA, 25 bp, Mus musculus
tttccttatgtcaagaagccttctg

SEQ ID NO: 969316 - DNA, 25 bp, Mus musculus
tttccttatgtctagaagccttctg

SEQ ID NO: 969317 - DNA, 25 bp, Mus musculus
tttccttatgttattggtcaaccat

SEQ ID NO: 969318 - DNA, 25 bp, Mus musculus
tttccttatgtttttggtcaaccat

SEQ ID NO: 969319 - DNA, 25 bp, Mus musculus
tttccttattttcctattacctcaa

SEQ ID NO: 969320 - DNA, 25 bp, Mus musculus
tttccttattttgctattacctcaa

SEQ ID NO: 969321 - DNA, 25 bp, Mus musculus
tttccttcaaggcaggtacaatcca

SEQ ID NO: 969322 - DNA, 25 bp, Mus musculus
tttccttcaagggaggtacaatcca

SEQ ID NO: 969323 - DNA, 25 bp, Mus musculus
tttccttcacctatattacagtatg

SEQ ID NO: 969324 - DNA, 25 bp, Mus musculus
tttccttcacctttattacagtatg

SEQ ID NO: 969325 - DNA, 25 bp, Mus musculus
tttccttcagaaccagcgacgattg

SEQ ID NO: 969326 - DNA, 25 bp, Mus musculus
tttccttcagaagcagcgacgattg

SEQ ID NO: 969327 - DNA, 25 bp, Mus musculus
tttccttcagccactttatagtcaa

SEQ ID NO: 969328 - DNA, 25 bp, Mus musculus
tttccttcagcctctttatagtcaa

SEQ ID NO: 969329 - DNA, 25 bp, Mus musculus
tttccttcatagcaagagcttcctt

SEQ ID NO: 969330 - DNA, 25 bp, Mus musculus
tttccttcataggaagagcttcctt

SEQ ID NO: 969331 - DNA, 25 bp, Mus musculus
tttccttcatataatcccttatatc

SEQ ID NO: 969332 - DNA, 25 bp, Mus musculus
tttccttcatattatcccttatatc

SEQ ID NO: 969333 - DNA, 25 bp, Mus musculus
tttccttcatccaaaccctcccact

SEQ ID NO: 969334 - DNA, 25 bp, Mus musculus
tttccttcatcctaaccctcccact

SEQ ID NO: 969335 - DNA, 25 bp, Mus musculus
tttccttcatgcaaccccattaaag

SEQ ID NO: 969336 - DNA, 25 bp, Mus musculus
tttccttcatgctaccccattaaag

SEQ ID NO: 969337 - DNA, 25 bp, Mus musculus
tttccttccaagaagacagacctgt

SEQ ID NO: 969338 - DNA, 25 bp, Mus musculus
tttccttccaagtagacagacctgt

SEQ ID NO: 969339 - DNA, 25 bp, Mus musculus
tttccttccaatccaaacagtctat

SEQ ID NO: 969340 - DNA, 25 bp, Mus musculus
tttccttccaatccaggctatgtat

SEQ ID NO: 969341 - DNA, 25 bp, Mus musculus
tttccttccaatgcaaacagtctat

SEQ ID NO: 969342 - DNA, 25 bp, Mus musculus
tttccttccaatgcaggctatgtat

SEQ ID NO: 969343 - DNA, 25 bp, Mus musculus
tttccttccagtcttgtatatattt

SEQ ID NO: 969344 - DNA, 25 bp, Mus musculus
tttccttccagtgttgtatatattt

SEQ ID NO: 969345 - DNA, 25 bp, Mus musculus
tttccttccatcctgtgagcagagc

SEQ ID NO: 969346 - DNA, 25 bp, Mus musculus
tttccttccatcgtgtgagcagagc

SEQ ID NO: 969347 - DNA, 25 bp, Mus musculus
tttccttcccaaaaggctgtatgta

SEQ ID NO: 969348 - DNA, 25 bp, Mus musculus
tttccttcccaaccagtcgatactg

SEQ ID NO: 969349 - DNA, 25 bp, Mus musculus
tttccttcccaagcagtcgatactg

SEQ ID NO: 969350 - DNA, 25 bp, Mus musculus
tttccttcccaataggctgtatgta

SEQ ID NO: 969351 - DNA, 25 bp, Mus musculus
tttccttcccacaatctccagaatg

SEQ ID NO: 969352 - DNA, 25 bp, Mus musculus
tttccttcccactatctccagaatg

SEQ ID NO: 969353 - DNA, 25 bp, Mus musculus
tttccttcccagatgcattttacaa

SEQ ID NO: 969354 - DNA, 25 bp, Mus musculus
tttccttcccagttgcattttacaa

SEQ ID NO: 969355 - DNA, 25 bp, Mus musculus
tttccttcccatagtgaccaacgca

SEQ ID NO: 969356 - DNA, 25 bp, Mus musculus
tttccttcccatctcattcaagaac

SEQ ID NO: 969357 - DNA, 25 bp, Mus musculus
tttccttcccatgtcattcaagaac

SEQ ID NO: 969358 - DNA, 25 bp, Mus musculus
tttccttcccattgtgaccaacgca

SEQ ID NO: 969359 - DNA, 25 bp, Mus musculus
tttccttccccaagtagaattgtac

SEQ ID NO: 969360 - DNA, 25 bp, Mus musculus
tttccttccccatgtagaattgtac

SEQ ID NO: 969361 - DNA, 25 bp, Mus musculus
tttccttccctaccagtgaaattgc

SEQ ID NO: 969362 - DNA, 25 bp, Mus musculus
tttccttccctaccgtttattgatg

SEQ ID NO: 969363 - DNA, 25 bp, Mus musculus
tttccttccctagcagtgaaattgc

SEQ ID NO: 969364 - DNA, 25 bp, Mus musculus
tttccttccctagcgtttattgatg

SEQ ID NO: 969365 - DNA, 25 bp, Mus musculus
tttccttccctgattaatggactct

SEQ ID NO: 969366 - DNA, 25 bp, Mus musculus
tttccttccctgtttaatggactct

SEQ ID NO: 969367 - DNA, 25 bp, Mus musculus
tttccttcctcgctttcctgaatac

SEQ ID NO: 969368 - DNA, 25 bp, Mus musculus
tttccttcctcggtttcctgaatac

SEQ ID NO: 969369 - DNA, 25 bp, Mus musculus
tttccttcctgacgcatagaacaca

SEQ ID NO: 969370 - DNA, 25 bp, Mus musculus
tttccttcctgaggcatagaacaca

SEQ ID NO: 969371 - DNA, 25 bp, Mus musculus
tttccttcctggaactaacattaag

SEQ ID NO: 969372 - DNA, 25 bp, Mus musculus
tttccttcctggtactaacattaag

SEQ ID NO: 969373 - DNA, 25 bp, Mus musculus
tttccttcctgtacacttagtgccc

SEQ ID NO: 969374 - DNA, 25 bp, Mus musculus
tttccttcctgtatgtccagcggtg

SEQ ID NO: 969375 - DNA, 25 bp, Mus musculus
tttccttcctgttcacttagtgccc

SEQ ID NO: 969376 - DNA, 25 bp, Mus musculus
tttccttcctgtttgtccagcggtg

SEQ ID NO: 969377 - DNA, 25 bp, Mus musculus
tttccttccttacacacttattttg

SEQ ID NO: 969378 - DNA, 25 bp, Mus musculus
tttccttccttagacacttattttg

SEQ ID NO: 969379 - DNA, 25 bp, Mus musculus
tttccttcgctgctattgtttaaag

SEQ ID NO: 969380 - DNA, 25 bp, Mus musculus
tttccttcgctggtattgtttaaag

SEQ ID NO: 969381 - DNA, 25 bp, Mus musculus
tttccttctcctcattttcaacaat

SEQ ID NO: 969382 - DNA, 25 bp, Mus musculus
tttccttctcctgattttcaacaat

SEQ ID NO: 969383 - DNA, 25 bp, Mus musculus
tttccttctctactctttgataaga

SEQ ID NO: 969384 - DNA, 25 bp, Mus musculus
tttccttctctagtctttgataaga

SEQ ID NO: 969385 - DNA, 25 bp, Mus musculus
tttccttctgcaatgcctatttaag

SEQ ID NO: 969386 - DNA, 25 bp, Mus musculus
tttccttctgcattgcctatttaag

SEQ ID NO: 969387 - DNA, 25 bp, Mus musculus
tttccttctgccaggactagcagta

SEQ ID NO: 969388 - DNA, 25 bp, Mus musculus
tttccttctgcctggactagcagta

SEQ ID NO: 969389 - DNA, 25 bp, Mus musculus
tttccttctggacctcaatgtacgt

SEQ ID NO: 969390 - DNA, 25 bp, Mus musculus
tttccttctggagctcaatgtacgt

SEQ ID NO: 969391 - DNA, 25 bp, Mus musculus
tttccttctggcacgtgacggacaa

SEQ ID NO: 969392 - DNA, 25 bp, Mus musculus
tttccttctggctcgtgacggacaa

SEQ ID NO: 969393 - DNA, 25 bp, Mus musculus
tttccttctgggaaaatgtgagctg

SEQ ID NO: 969394 - DNA, 25 bp, Mus musculus
tttccttctgggtaaatgtgagctg

SEQ ID NO: 969395 - DNA, 25 bp, Mus musculus
tttccttctgtccttgtgcacagga

SEQ ID NO: 969396 - DNA, 25 bp, Mus musculus
tttccttctgtcgttgtgcacagga

SEQ ID NO: 969397 - DNA, 25 bp, Mus musculus
tttccttctgtgatgtcacttcctg

SEQ ID NO: 969398 - DNA, 25 bp, Mus musculus
tttccttctgtgttgtcacttcctg

SEQ ID NO: 969399 - DNA, 25 bp, Mus musculus
tttccttcttagctccaggtgagaa

SEQ ID NO: 969400 - DNA, 25 bp, Mus musculus
tttccttcttaggtccaggtgagaa

SEQ ID NO: 969401 - DNA, 25 bp, Mus musculus
tttccttcttccaaatagtttcaga

SEQ ID NO: 969402 - DNA, 25 bp, Mus musculus
tttccttcttcctaatagtttcaga

SEQ ID NO: 969403 - DNA, 25 bp, Mus musculus
tttccttcttcgagtgaagatgctg

SEQ ID NO: 969404 - DNA, 25 bp, Mus musculus
tttccttcttcgtgtgaagatgctg

SEQ ID NO: 969405 - DNA, 25 bp, Mus musculus
tttccttctttaagcaatcggccct

SEQ ID NO: 969406 - DNA, 25 bp, Mus musculus
tttccttctttactgaatagggtca

SEQ ID NO: 969407 - DNA, 25 bp, Mus musculus
tttccttctttagtgaatagggtca

SEQ ID NO: 969408 - DNA, 25 bp, Mus musculus
tttccttctttatgcaatcggccct

SEQ ID NO: 969409 - DNA, 25 bp, Mus musculus
tttccttgaactactctctgttaga

SEQ ID NO: 969410 - DNA, 25 bp, Mus musculus
tttccttgaacttctctctgttaga

SEQ ID NO: 969411 - DNA, 25 bp, Mus musculus
tttccttgacagagcttaggcggcc

SEQ ID NO: 969412 - DNA, 25 bp, Mus musculus
tttccttgacagtgcttaggcggcc

SEQ ID NO: 969413 - DNA, 25 bp, Mus musculus
tttccttgacttcttaaaacagtgt

SEQ ID NO: 969414 - DNA, 25 bp, Mus musculus
tttccttgacttgttaaaacagtgt

SEQ ID NO: 969415 - DNA, 25 bp, Mus musculus
tttccttgagcacattatatattct

SEQ ID NO: 969416 - DNA, 25 bp, Mus musculus
tttccttgagcagattatatattct

SEQ ID NO: 969417 - DNA, 25 bp, Mus musculus
tttccttgcacgctagctagtagct

SEQ ID NO: 969418 - DNA, 25 bp, Mus musculus
tttccttgcacggtagctagtagct

SEQ ID NO: 969419 - DNA, 25 bp, Mus musculus
tttccttgcatgacagctactacag

SEQ ID NO: 969420 - DNA, 25 bp, Mus musculus
tttccttgcatgtcagctactacag

SEQ ID NO: 969421 - DNA, 25 bp, Mus musculus
tttccttgcattcttatccgtcttc

SEQ ID NO: 969422 - DNA, 25 bp, Mus musculus
tttccttgcattgttatccgtcttc

SEQ ID NO: 969423 - DNA, 25 bp, Mus musculus
tttccttgccaaagaatccaactgt

SEQ ID NO: 969424 - DNA, 25 bp, Mus musculus
tttccttgccaatgaatccaactgt

SEQ ID NO: 969425 - DNA, 25 bp, Mus musculus
tttccttgccataaagctgtcacca

SEQ ID NO: 969426 - DNA, 25 bp, Mus musculus
tttccttgccattaagctgtcacca

SEQ ID NO: 969427 - DNA, 25 bp, Mus musculus
tttccttgcctactggaaccacaaa

SEQ ID NO: 969428 - DNA, 25 bp, Mus musculus
tttccttgcctagtggaaccacaaa

SEQ ID NO: 969429 - DNA, 25 bp, Mus musculus
tttccttgcggactggcttgctgtg

SEQ ID NO: 969430 - DNA, 25 bp, Mus musculus
tttccttgcggagtggcttgctgtg

SEQ ID NO: 969431 - DNA, 25 bp, Mus musculus
tttccttgctagattggccatctgc

SEQ ID NO: 969432 - DNA, 25 bp, Mus musculus
tttccttgctagtttggccatctgc

SEQ ID NO: 969433 - DNA, 25 bp, Mus musculus
tttccttgctgcatttactgtaggt

SEQ ID NO: 969434 - DNA, 25 bp, Mus musculus
tttccttgctgcttttactgtaggt

SEQ ID NO: 969435 - DNA, 25 bp, Mus musculus
tttccttgctggatcctgaagcaga

SEQ ID NO: 969436 - DNA, 25 bp, Mus musculus
tttccttgctggttcctgaagcaga

SEQ ID NO: 969437 - DNA, 25 bp, Mus musculus
tttccttgcttcataaggctttagc

SEQ ID NO: 969438 - DNA, 25 bp, Mus musculus
tttccttgcttcttaaggctttagc

SEQ ID NO: 969439 - DNA, 25 bp, Mus musculus
tttccttggcacaataaaaccaaat

SEQ ID NO: 969440 - DNA, 25 bp, Mus musculus
tttccttggcactataaaaccaaat

SEQ ID NO: 969441 - DNA, 25 bp, Mus musculus
tttccttggcttatatcatgctaat

SEQ ID NO: 969442 - DNA, 25 bp, Mus musculus
tttccttggcttttatcatgctaat

SEQ ID NO: 969443 - DNA, 25 bp, Mus musculus
tttccttgtaatataaacaggcctg

SEQ ID NO: 969444 - DNA, 25 bp, Mus musculus
tttccttgtaatttaaacaggcctg

SEQ ID NO: 969445 - DNA, 25 bp, Mus musculus
tttccttgtactcaattgggtaaga

SEQ ID NO: 969446 - DNA, 25 bp, Mus musculus
tttccttgtactgaattgggtaaga

SEQ ID NO: 969447 - DNA, 25 bp, Mus musculus
tttccttgtcaaatgccagtgctgg

SEQ ID NO: 969448 - DNA, 25 bp, Mus musculus
tttccttgtcaattgccagtgctgg

SEQ ID NO: 969449 - DNA, 25 bp, Mus musculus
tttccttgtcatcatcttttgctac

SEQ ID NO: 969450 - DNA, 25 bp, Mus musculus
tttccttgtcatgatcttttgctac

SEQ ID NO: 969451 - DNA, 25 bp, Mus musculus
tttccttgtctgctgggaactgcat

SEQ ID NO: 969452 - DNA, 25 bp, Mus musculus
tttccttgtctggtgggaactgcat

SEQ ID NO: 969453 - DNA, 25 bp, Mus musculus
tttccttgtgaaacttatttggtat

SEQ ID NO: 969454 - DNA, 25 bp, Mus musculus
tttccttgtgaatcttatttggtat

SEQ ID NO: 969455 - DNA, 25 bp, Mus musculus
tttccttgtggtaaatgaacttggc

SEQ ID NO: 969456 - DNA, 25 bp, Mus musculus
tttccttgtggttaatgaacttggc

SEQ ID NO: 969457 - DNA, 25 bp, Mus musculus
tttccttgttccattattcctcaat

SEQ ID NO: 969458 - DNA, 25 bp, Mus musculus
tttccttgttcctttattcctcaat

SEQ ID NO: 969459 - DNA, 25 bp, Mus musculus
tttccttgttctccggtgttgctat

SEQ ID NO: 969460 - DNA, 25 bp, Mus musculus
tttccttgttctgcggtgttgctat

SEQ ID NO: 969461 - DNA, 25 bp, Mus musculus
tttccttgttgtcctagccttcatg

SEQ ID NO: 969462 - DNA, 25 bp, Mus musculus
tttccttgttgtgctagccttcatg

SEQ ID NO: 969463 - DNA, 25 bp, Mus musculus
tttccttgtttactgggtccatcag

SEQ ID NO: 969464 - DNA, 25 bp, Mus musculus
tttccttgtttagtgggtccatcag

SEQ ID NO: 969465 - DNA, 25 bp, Mus musculus
tttcctttaaatctctgtctcagtt

SEQ ID NO: 969466 - DNA, 25 bp, Mus musculus
tttcctttaaatgtctgtctcagtt

SEQ ID NO: 969467 - DNA, 25 bp, Mus musculus
tttcctttaccaccaatatctgttg

SEQ ID NO: 969468 - DNA, 25 bp, Mus musculus
tttcctttaccagcaatatctgttg

SEQ ID NO: 969469 - DNA, 25 bp, Mus musculus
tttcctttacttccgttcctggaag

SEQ ID NO: 969470 - DNA, 25 bp, Mus musculus
tttcctttacttgcgttcctggaag

SEQ ID NO: 969471 - DNA, 25 bp, Mus musculus
tttcctttagatcaattgagcacag

SEQ ID NO: 969472 - DNA, 25 bp, Mus musculus
tttcctttagatgaattgagcacag

SEQ ID NO: 969473 - DNA, 25 bp, Mus musculus
tttcctttagctactagttctttct

SEQ ID NO: 969474 - DNA, 25 bp, Mus musculus
tttcctttagcttctagttctttct

SEQ ID NO: 969475 - DNA, 25 bp, Mus musculus
tttcctttaggcaagactccctcta

SEQ ID NO: 969476 - DNA, 25 bp, Mus musculus
tttcctttaggcaaggctacctctt

SEQ ID NO: 969477 - DNA, 25 bp, Mus musculus
tttcctttaggctagactccctcta

SEQ ID NO: 969478 - DNA, 25 bp, Mus musculus
tttcctttaggctaggctacctctt

SEQ ID NO: 969479 - DNA, 25 bp, Mus musculus
tttcctttaggtacttatatgacaa

SEQ ID NO: 969480 - DNA, 25 bp, Mus musculus
tttcctttaggttcttatatgacaa

SEQ ID NO: 969481 - DNA, 25 bp, Mus musculus
tttcctttcagcagtagtgactgct

SEQ ID NO: 969482 - DNA, 25 bp, Mus musculus
tttcctttcagctgtagtgactgct

SEQ ID NO: 969483 - DNA, 25 bp, Mus musculus
tttcctttcatgatcttggcttcta

SEQ ID NO: 969484 - DNA, 25 bp, Mus musculus
tttcctttcatgttcttggcttcta

SEQ ID NO: 969485 - DNA, 25 bp, Mus musculus
tttcctttcattaagcctcagcagt

SEQ ID NO: 969486 - DNA, 25 bp, Mus musculus
tttcctttcatttagcctcagcagt

SEQ ID NO: 969487 - DNA, 25 bp, Mus musculus
tttcctttccaaaagcccctgagta

SEQ ID NO: 969488 - DNA, 25 bp, Mus musculus
tttcctttccaatagcccctgagta

SEQ ID NO: 969489 - DNA, 25 bp, Mus musculus
tttcctttccagcagtgtttagtga

SEQ ID NO: 969490 - DNA, 25 bp, Mus musculus
tttcctttccaggagtgtttagtga

SEQ ID NO: 969491 - DNA, 25 bp, Mus musculus
tttcctttcccaacactgagtcgag

SEQ ID NO: 969492 - DNA, 25 bp, Mus musculus
tttcctttcccatcactgagtcgag

SEQ ID NO: 969493 - DNA, 25 bp, Mus musculus
tttcctttccccagtggcacactac

SEQ ID NO: 969494 - DNA, 25 bp, Mus musculus
tttcctttcccctgtggcacactac

SEQ ID NO: 969495 - DNA, 25 bp, Mus musculus
tttcctttcctcaagcagcgtgaga

SEQ ID NO: 969496 - DNA, 25 bp, Mus musculus
tttcctttcctctagcagcgtgaga

SEQ ID NO: 969497 - DNA, 25 bp, Mus musculus
tttcctttccttctcgtcatctgga

SEQ ID NO: 969498 - DNA, 25 bp, Mus musculus
tttcctttccttgtcgtcatctgga

SEQ ID NO: 969499 - DNA, 25 bp, Mus musculus
tttcctttcgaaaggcactacctta

SEQ ID NO: 969500 - DNA, 25 bp, Mus musculus
tttcctttcgaatggcactacctta

SEQ ID NO: 969501 - DNA, 25 bp, Mus musculus
tttcctttctaaccaccattgggta

SEQ ID NO: 969502 - DNA, 25 bp, Mus musculus
tttcctttctaagcaccattgggta

SEQ ID NO: 969503 - DNA, 25 bp, Mus musculus
tttcctttctaccaacttcagacca

SEQ ID NO: 969504 - DNA, 25 bp, Mus musculus
tttcctttctacgaacttcagacca

SEQ ID NO: 969505 - DNA, 25 bp, Mus musculus
tttcctttctctcgaggcatcatgc

SEQ ID NO: 969506 - DNA, 25 bp, Mus musculus
tttcctttctctggaggcatcatgc

SEQ ID NO: 969507 - DNA, 25 bp, Mus musculus
tttcctttcttcaactcttttgatg

SEQ ID NO: 969508 - DNA, 25 bp, Mus musculus
tttcctttcttctactcttttgatg

SEQ ID NO: 969509 - DNA, 25 bp, Mus musculus
tttcctttcttgaatgagagggtct

SEQ ID NO: 969510 - DNA, 25 bp, Mus musculus
tttcctttcttgtatgagagggtct

SEQ ID NO: 969511 - DNA, 25 bp, Mus musculus
tttcctttctttcggtgctctgtcc

SEQ ID NO: 969512 - DNA, 25 bp, Mus musculus
tttcctttctttgggtgctctgtcc

SEQ ID NO: 969513 - DNA, 25 bp, Mus musculus
tttcctttgagactgggtacaccca

SEQ ID NO: 969514 - DNA, 25 bp, Mus musculus
tttcctttgagagtgggtacaccca

SEQ ID NO: 969515 - DNA, 25 bp, Mus musculus
tttcctttgatcatgaccactcatg

SEQ ID NO: 969516 - DNA, 25 bp, Mus musculus
tttcctttgatcttgaccactcatg

SEQ ID NO: 969517 - DNA, 25 bp, Mus musculus
tttcctttgattattgctcctaatg

SEQ ID NO: 969518 - DNA, 25 bp, Mus musculus
tttcctttgatttttgctcctaatg

SEQ ID NO: 969519 - DNA, 25 bp, Mus musculus
tttcctttgcagagtcatcttgatt

SEQ ID NO: 969520 - DNA, 25 bp, Mus musculus
tttcctttgcagtgtcatcttgatt

SEQ ID NO: 969521 - DNA, 25 bp, Mus musculus
tttcctttgcctaccatgatgatgc

SEQ ID NO: 969522 - DNA, 25 bp, Mus musculus
tttcctttgcctccatttgtatcta

SEQ ID NO: 969523 - DNA, 25 bp, Mus musculus
tttcctttgcctgcatttgtatcta

SEQ ID NO: 969524 - DNA, 25 bp, Mus musculus
tttcctttgccttccatgatgatgc

SEQ ID NO: 969525 - DNA, 25 bp, Mus musculus
tttcctttgctccacgaggatggga

SEQ ID NO: 969526 - DNA, 25 bp, Mus musculus
tttcctttgctcgacgaggatggga

SEQ ID NO: 969527 - DNA, 25 bp, Mus musculus
tttcctttggaaaactttgtgcgtt

SEQ ID NO: 969528 - DNA, 25 bp, Mus musculus
tttcctttggaatactttgtgcgtt

SEQ ID NO: 969529 - DNA, 25 bp, Mus musculus
tttcctttggatatgttctcatgga

SEQ ID NO: 969530 - DNA, 25 bp, Mus musculus
tttcctttggatttgttctcatgga

SEQ ID NO: 969531 - DNA, 25 bp, Mus musculus
tttcctttggctacagcaagaaagg

SEQ ID NO: 969532 - DNA, 25 bp, Mus musculus
tttcctttggcttcagcaagaaagg

SEQ ID NO: 969533 - DNA, 25 bp, Mus musculus
tttcctttgggaaagcatcctaaat

SEQ ID NO: 969534 - DNA, 25 bp, Mus musculus
tttcctttgggactccactgcactt

SEQ ID NO: 969535 - DNA, 25 bp, Mus musculus
tttcctttgggagtccactgcactt

SEQ ID NO: 969536 - DNA, 25 bp, Mus musculus
tttcctttgggatagcatcctaaat

SEQ ID NO: 969537 - DNA, 25 bp, Mus musculus
tttcctttgtatacacttccatttt

SEQ ID NO: 969538 - DNA, 25 bp, Mus musculus
tttcctttgtattcacttccatttt

SEQ ID NO: 969539 - DNA, 25 bp, Mus musculus
tttcctttgtctatgtagccccata

SEQ ID NO: 969540 - DNA, 25 bp, Mus musculus
tttcctttgtctcacgtctgtgaaa

SEQ ID NO: 969541 - DNA, 25 bp, Mus musculus
tttcctttgtctgacgtctgtgaaa

SEQ ID NO: 969542 - DNA, 25 bp, Mus musculus
tttcctttgtctttgtagccccata

SEQ ID NO: 969543 - DNA, 25 bp, Mus musculus
tttccttttacaatccagggacact

SEQ ID NO: 969544 - DNA, 25 bp, Mus musculus
tttccttttacattccagggacact

SEQ ID NO: 969545 - DNA, 25 bp, Mus musculus
tttccttttctgagtgtgtacacct

SEQ ID NO: 969546 - DNA, 25 bp, Mus musculus
tttccttttctgtgtgtgtacacct

SEQ ID NO: 969547 - DNA, 25 bp, Mus musculus
tttccttttgctaaagcacttcatc

SEQ ID NO: 969548 - DNA, 25 bp, Mus musculus
tttccttttgctcccaaggtgtgac

SEQ ID NO: 969549 - DNA, 25 bp, Mus musculus
tttccttttgctgccaaggtgtgac

SEQ ID NO: 969550 - DNA, 25 bp, Mus musculus
tttccttttgcttaagcacttcatc

SEQ ID NO: 969551 - DNA, 25 bp, Mus musculus
tttccttttgtcacattatccttgt

SEQ ID NO: 969552 - DNA, 25 bp, Mus musculus
tttccttttgtctcattatccttgt

SEQ ID NO: 969553 - DNA, 25 bp, Mus musculus
tttcctttttcacacagctacttta

SEQ ID NO: 969554 - DNA, 25 bp, Mus musculus
tttcctttttcagacagctacttta

SEQ ID NO: 969555 - DNA, 25 bp, Mus musculus
tttcctttttctcatgtgaaccagt

SEQ ID NO: 969556 - DNA, 25 bp, Mus musculus
tttcctttttctgatgtgaaccagt

SEQ ID NO: 969557 - DNA, 25 bp, Mus musculus
tttcctttttgtcatgttctcgcct

SEQ ID NO: 969558 - DNA, 25 bp, Mus musculus
tttcctttttgtgatgttctcgcct

SEQ ID NO: 969559 - DNA, 25 bp, Mus musculus
tttccttttttacatactggccact

SEQ ID NO: 969560 - DNA, 25 bp, Mus musculus
tttccttttttagatactggccact

SEQ ID NO: 969561 - DNA, 25 bp, Mus musculus
tttccttttttgactaatgcggcag

SEQ ID NO: 969562 - DNA, 25 bp, Mus musculus
tttccttttttgtctaatgcggcag

SEQ ID NO: 969563 - DNA, 25 bp, Mus musculus
tttcgaaaccctcgtagccctggct

SEQ ID NO: 969564 - DNA, 25 bp, Mus musculus
tttcgaaaccctggtagccctggct

SEQ ID NO: 969565 - DNA, 25 bp, Mus musculus
tttcgaaactagacccgtctcactt

SEQ ID NO: 969566 - DNA, 25 bp, Mus musculus
tttcgaaactagtcccgtctcactt

SEQ ID NO: 969567 - DNA, 25 bp, Mus musculus
tttcgaaactctacagctacatgcc

SEQ ID NO: 969568 - DNA, 25 bp, Mus musculus
tttcgaaactcttcagctacatgcc

SEQ ID NO: 969569 - DNA, 25 bp, Mus musculus
tttcgaaaggtgatcctgcctgacc

SEQ ID NO: 969570 - DNA, 25 bp, Mus musculus
tttcgaaaggtgttcctgcctgacc

SEQ ID NO: 969571 - DNA, 25 bp, Mus musculus
tttcgaaccacgaacctttatgcct

SEQ ID NO: 969572 - DNA, 25 bp, Mus musculus
tttcgaaccacgtacctttatgcct

SEQ ID NO: 969573 - DNA, 25 bp, Mus musculus
tttcgaagatccaccgccaagaata

SEQ ID NO: 969574 - DNA, 25 bp, Mus musculus
tttcgaagatcctccgccaagaata

SEQ ID NO: 969575 - DNA, 25 bp, Mus musculus
tttcgaagccgtacttccagaggga

SEQ ID NO: 969576 - DNA, 25 bp, Mus musculus
tttcgaagccgttcttccagaggga

SEQ ID NO: 969577 - DNA, 25 bp, Mus musculus
tttcgaagcgaaactgggtgcagac

SEQ ID NO: 969578 - DNA, 25 bp, Mus musculus
tttcgaagcgaatctgggtgcagac

SEQ ID NO: 969579 - DNA, 25 bp, Mus musculus
tttcgaatggcactaccttagggac

SEQ ID NO: 969580 - DNA, 25 bp, Mus musculus
tttcgaatggcagtaccttagggac

SEQ ID NO: 969581 - DNA, 25 bp, Mus musculus
tttcgaattttcacttcagcactct

SEQ ID NO: 969582 - DNA, 25 bp, Mus musculus
tttcgaattttctcttcagcactct

SEQ ID NO: 969583 - DNA, 25 bp, Mus musculus
tttcgacacacaactttcttcactg

SEQ ID NO: 969584 - DNA, 25 bp, Mus musculus
tttcgacacacatctttcttcactg

SEQ ID NO: 969585 - DNA, 25 bp, Mus musculus
tttcgacaccctattttataatatg

SEQ ID NO: 969586 - DNA, 25 bp, Mus musculus
tttcgacacccttttttataatatg

SEQ ID NO: 969587 - DNA, 25 bp, Mus musculus
tttcgacagcatctagaaagacctg

SEQ ID NO: 969588 - DNA, 25 bp, Mus musculus
tttcgacagcatgtagaaagacctg

SEQ ID NO: 969589 - DNA, 25 bp, Mus musculus
tttcgacatcccaccaaaggaagca

SEQ ID NO: 969590 - DNA, 25 bp, Mus musculus
tttcgacatccctccaaaggaagca

SEQ ID NO: 969591 - DNA, 25 bp, Mus musculus
tttcgaccagataagcatttgcttt

SEQ ID NO: 969592 - DNA, 25 bp, Mus musculus
tttcgaccagattagcatttgcttt

SEQ ID NO: 969593 - DNA, 25 bp, Mus musculus
tttcgacccttgaacaataataaag

SEQ ID NO: 969594 - DNA, 25 bp, Mus musculus
tttcgacccttgtacaataataaag

SEQ ID NO: 969595 - DNA, 25 bp, Mus musculus
tttcgactacacacaaagatgtttg

SEQ ID NO: 969596 - DNA, 25 bp, Mus musculus
tttcgactacactcaaagatgtttg

SEQ ID NO: 969597 - DNA, 25 bp, Mus musculus
tttcgactcgctcaacgcgttcagg

SEQ ID NO: 969598 - DNA, 25 bp, Mus musculus
tttcgactcgctgaacgcgttcagg

SEQ ID NO: 969599 - DNA, 25 bp, Mus musculus
tttcgactgatgactcaggacttct

SEQ ID NO: 969600 - DNA, 25 bp, Mus musculus
tttcgactgatgtctcaggacttct

SEQ ID NO: 969601 - DNA, 25 bp, Mus musculus
tttcgactttgaatcttgccggtac

SEQ ID NO: 969602 - DNA, 25 bp, Mus musculus
tttcgactttgattcttgccggtac

SEQ ID NO: 969603 - DNA, 25 bp, Mus musculus
tttcgagatcagacaacctccgcat

SEQ ID NO: 969604 - DNA, 25 bp, Mus musculus
tttcgagatcagtcaacctccgcat

SEQ ID NO: 969605 - DNA, 25 bp, Mus musculus
tttcgagcagttcgcgctgggttac

SEQ ID NO: 969606 - DNA, 25 bp, Mus musculus
tttcgagcagttggcgctgggttac

SEQ ID NO: 969607 - DNA, 25 bp, Mus musculus
tttcgagccagcataggtgcaacaa

SEQ ID NO: 969608 - DNA, 25 bp, Mus musculus
tttcgagccagcttaggtgcaacaa

SEQ ID NO: 969609 - DNA, 25 bp, Mus musculus
tttcgagcctcaagttgctatccca

SEQ ID NO: 969610 - DNA, 25 bp, Mus musculus
tttcgagcctcatgttgctatccca

SEQ ID NO: 969611 - DNA, 25 bp, Mus musculus
tttcgagcggctaccatgagtgcgg

SEQ ID NO: 969612 - DNA, 25 bp, Mus musculus
tttcgagcggcttccatgagtgcgg

SEQ ID NO: 969613 - DNA, 25 bp, Mus musculus
tttcgaggacctcagaggccagccg

SEQ ID NO: 969614 - DNA, 25 bp, Mus musculus
tttcgaggacctgagaggccagccg

SEQ ID NO: 969615 - DNA, 25 bp, Mus musculus
tttcgagtggatatcagtggccgtg

SEQ ID NO: 969616 - DNA, 25 bp, Mus musculus
tttcgagtggatttcagtggccgtg

SEQ ID NO: 969617 - DNA, 25 bp, Mus musculus
tttcgagttcgacccatgcagcacc

SEQ ID NO: 969618 - DNA, 25 bp, Mus musculus
tttcgagttcgagccatgcagcacc

SEQ ID NO: 969619 - DNA, 25 bp, Mus musculus
tttcgataaaaactatgtcctattt

SEQ ID NO: 969620 - DNA, 25 bp, Mus musculus
tttcgataaaaagtatgtcctattt

SEQ ID NO: 969621 - DNA, 25 bp, Mus musculus
tttcgatcctcgacaggtgcaggtc

SEQ ID NO: 969622 - DNA, 25 bp, Mus musculus
tttcgatcctcgtcaggtgcaggtc

SEQ ID NO: 969623 - DNA, 25 bp, Mus musculus
tttcgatctctacccagagtgtggc

SEQ ID NO: 969624 - DNA, 25 bp, Mus musculus
tttcgatctctagccagagtgtggc

SEQ ID NO: 969625 - DNA, 25 bp, Mus musculus
tttcgatcttcaaaacggacaaact

SEQ ID NO: 969626 - DNA, 25 bp, Mus musculus
tttcgatcttcataacggacaaact

SEQ ID NO: 969627 - DNA, 25 bp, Mus musculus
tttcgatgatcacctcaaacctaga

SEQ ID NO: 969628 - DNA, 25 bp, Mus musculus
tttcgatgatcagctcaaacctaga

SEQ ID NO: 969629 - DNA, 25 bp, Mus musculus
tttcgatggcgtctctgcctcccga

SEQ ID NO: 969630 - DNA, 25 bp, Mus musculus
tttcgatggcgtgtctgcctcccga

SEQ ID NO: 969631 - DNA, 25 bp, Mus musculus
tttcgatggcttatgcggcgtcact

SEQ ID NO: 969632 - DNA, 25 bp, Mus musculus
tttcgatggcttttgcggcgtcact

SEQ ID NO: 969633 - DNA, 25 bp, Mus musculus
tttcgattgttaatggtctgggctt

SEQ ID NO: 969634 - DNA, 25 bp, Mus musculus
tttcgattgttattggtctgggctt

SEQ ID NO: 969635 - DNA, 25 bp, Mus musculus
tttcgcaaacggctggaacatgtgt

SEQ ID NO: 969636 - DNA, 25 bp, Mus musculus
tttcgcaaacgggtggaacatgtgt

SEQ ID NO: 969637 - DNA, 25 bp, Mus musculus
tttcgcaagaagagtgagtcctgct

SEQ ID NO: 969638 - DNA, 25 bp, Mus musculus
tttcgcaagaagtgtgagtcctgct

SEQ ID NO: 969639 - DNA, 25 bp, Mus musculus
tttcgcacacatctttggaccctca

SEQ ID NO: 969640 - DNA, 25 bp, Mus musculus
tttcgcacacatgtttggaccctca

SEQ ID NO: 969641 - DNA, 25 bp, Mus musculus
tttcgcacatccagtactagtcttt

SEQ ID NO: 969642 - DNA, 25 bp, Mus musculus
tttcgcacatcctgtactagtcttt

SEQ ID NO: 969643 - DNA, 25 bp, Mus musculus
tttcgcagacggcattcgggtcaac

SEQ ID NO: 969644 - DNA, 25 bp, Mus musculus
tttcgcagacgggattcgggtcaac

SEQ ID NO: 969645 - DNA, 25 bp, Mus musculus
tttcgcagataacacacctaacact

SEQ ID NO: 969646 - DNA, 25 bp, Mus musculus
tttcgcagataagacacctaacact

SEQ ID NO: 969647 - DNA, 25 bp, Mus musculus
tttcgcagcaccaagtatcttacag

SEQ ID NO: 969648 - DNA, 25 bp, Mus musculus
tttcgcagcacctagtatcttacag

SEQ ID NO: 969649 - DNA, 25 bp, Mus musculus
tttcgcaggataaggagctcagtga

SEQ ID NO: 969650 - DNA, 25 bp, Mus musculus
tttcgcaggatatggagctcagtga

SEQ ID NO: 969651 - DNA, 25 bp, Mus musculus
tttcgcatcaacatttcgggttttg

SEQ ID NO: 969652 - DNA, 25 bp, Mus musculus
tttcgcatcaacttttcgggttttg

SEQ ID NO: 969653 - DNA, 25 bp, Mus musculus
tttcgccatggaagggcccagcagt

SEQ ID NO: 969654 - DNA, 25 bp, Mus musculus
tttcgccatggatgggcccagcagt

SEQ ID NO: 969655 - DNA, 25 bp, Mus musculus
tttcgccctaaaccacccagaatat

SEQ ID NO: 969656 - DNA, 25 bp, Mus musculus
tttcgccctaaagcacccagaatat

SEQ ID NO: 969657 - DNA, 25 bp, Mus musculus
tttcgccctctccatagtatagaag

SEQ ID NO: 969658 - DNA, 25 bp, Mus musculus
tttcgccctctcgatagtatagaag

SEQ ID NO: 969659 - DNA, 25 bp, Mus musculus
tttcgccctcttcgcagtgacaagt

SEQ ID NO: 969660 - DNA, 25 bp, Mus musculus
tttcgccctcttggcagtgacaagt

SEQ ID NO: 969661 - DNA, 25 bp, Mus musculus
tttcgccgtggcatagataatgact

SEQ ID NO: 969662 - DNA, 25 bp, Mus musculus
tttcgccgtggcttagataatgact

SEQ ID NO: 969663 - DNA, 25 bp, Mus musculus
tttcgccgtttcagttttataatat

SEQ ID NO: 969664 - DNA, 25 bp, Mus musculus
tttcgccgtttctgttttataatat

SEQ ID NO: 969665 - DNA, 25 bp, Mus musculus
tttcgcctatgcaaaaaacggaaca

SEQ ID NO: 969666 - DNA, 25 bp, Mus musculus
tttcgcctatgctaaaaacggaaca

SEQ ID NO: 969667 - DNA, 25 bp, Mus musculus
tttcgcgagtagctcaattggtgtt

SEQ ID NO: 969668 - DNA, 25 bp, Mus musculus
tttcgcgagtaggtcaattggtgtt

SEQ ID NO: 969669 - DNA, 25 bp, Mus musculus
tttcgcggtgctactgtgggaactg

SEQ ID NO: 969670 - DNA, 25 bp, Mus musculus
tttcgcggtgcttctgtgggaactg

SEQ ID NO: 969671 - DNA, 25 bp, Mus musculus
tttcgcgtacttactccaattgtaa

SEQ ID NO: 969672 - DNA, 25 bp, Mus musculus
tttcgcgtactttctccaattgtaa

SEQ ID NO: 969673 - DNA, 25 bp, Mus musculus
tttcgctcagagaaccttgcactat

SEQ ID NO: 969674 - DNA, 25 bp, Mus musculus
tttcgctcagagtaccttgcactat

SEQ ID NO: 969675 - DNA, 25 bp, Mus musculus
tttcgctccttccttgtaaatatcg

SEQ ID NO: 969676 - DNA, 25 bp, Mus musculus
tttcgctccttcgttgtaaatatcg

SEQ ID NO: 969677 - DNA, 25 bp, Mus musculus
tttcgctgacaaagggcttctccac

SEQ ID NO: 969678 - DNA, 25 bp, Mus musculus
tttcgctgacaatgggcttctccac

SEQ ID NO: 969679 - DNA, 25 bp, Mus musculus
tttcgcttcctaccttagagaactt

SEQ ID NO: 969680 - DNA, 25 bp, Mus musculus
tttcgcttcctagcttagagaactt

SEQ ID NO: 969681 - DNA, 25 bp, Mus musculus
tttcgcttcttaacttgagacctca

SEQ ID NO: 969682 - DNA, 25 bp, Mus musculus
tttcgcttcttatcttgagacctca

SEQ ID NO: 969683 - DNA, 25 bp, Mus musculus
tttcgcttgtgaaaggactggtgct

SEQ ID NO: 969684 - DNA, 25 bp, Mus musculus
tttcgcttgtgataggactggtgct

SEQ ID NO: 969685 - DNA, 25 bp, Mus musculus
tttcgctttcagcttccgtctgaac

SEQ ID NO: 969686 - DNA, 25 bp, Mus musculus
tttcgctttcaggttccgtctgaac

SEQ ID NO: 969687 - DNA, 25 bp, Mus musculus
tttcgctttctgagatcacacgcag

SEQ ID NO: 969688 - DNA, 25 bp, Mus musculus
tttcgctttctgtgatcacacgcag

SEQ ID NO: 969689 - DNA, 25 bp, Mus musculus
tttcggaacaggcaagacaccacca

SEQ ID NO: 969690 - DNA, 25 bp, Mus musculus
tttcggaacagggaagacaccacca

SEQ ID NO: 969691 - DNA, 25 bp, Mus musculus
tttcggaactggaaatgaccatcct

SEQ ID NO: 969692 - DNA, 25 bp, Mus musculus
tttcggaactggtaatgaccatcct

SEQ ID NO: 969693 - DNA, 25 bp, Mus musculus
tttcggacaccccttgctgctcaga

SEQ ID NO: 969694 - DNA, 25 bp, Mus musculus
tttcggacacccgttgctgctcaga

SEQ ID NO: 969695 - DNA, 25 bp, Mus musculus
tttcggagttcgatcgtgctataaa

SEQ ID NO: 969696 - DNA, 25 bp, Mus musculus
tttcggagttcgttcgtgctataaa

SEQ ID NO: 969697 - DNA, 25 bp, Mus musculus
tttcggagtttcaggctagttagaa

SEQ ID NO: 969698 - DNA, 25 bp, Mus musculus
tttcggagtttctggctagttagaa

SEQ ID NO: 969699 - DNA, 25 bp, Mus musculus
tttcggatttatactggagcttggc

SEQ ID NO: 969700 - DNA, 25 bp, Mus musculus
tttcggatttattctggagcttggc

SEQ ID NO: 969701 - DNA, 25 bp, Mus musculus
tttcggcaacacaactgaatgtact

SEQ ID NO: 969702 - DNA, 25 bp, Mus musculus
tttcggcaacactactgaatgtact

SEQ ID NO: 969703 - DNA, 25 bp, Mus musculus
tttcggcaagaaactaactttaggc

SEQ ID NO: 969704 - DNA, 25 bp, Mus musculus
tttcggcaagaatctaactttaggc

SEQ ID NO: 969705 - DNA, 25 bp, Mus musculus
tttcggcacctgcacaaccttgtgg

SEQ ID NO: 969706 - DNA, 25 bp, Mus musculus
tttcggcacctggacaaccttgtgg

SEQ ID NO: 969707 - DNA, 25 bp, Mus musculus
tttcggcacggacctgcgagcctaa

SEQ ID NO: 969708 - DNA, 25 bp, Mus musculus
tttcggcacggagctgcgagcctaa

SEQ ID NO: 969709 - DNA, 25 bp, Mus musculus
tttcggcatctgcaaatctgacttt

SEQ ID NO: 969710 - DNA, 25 bp, Mus musculus
tttcggcatctggaaatctgacttt

SEQ ID NO: 969711 - DNA, 25 bp, Mus musculus
tttcggccacctagctggcggctat

SEQ ID NO: 969712 - DNA, 25 bp, Mus musculus
tttcggccaccttgctggcggctat

SEQ ID NO: 969713 - DNA, 25 bp, Mus musculus
tttcggccatccaaagaccaaaggt

SEQ ID NO: 969714 - DNA, 25 bp, Mus musculus
tttcggccatcctaagaccaaaggt

SEQ ID NO: 969715 - DNA, 25 bp, Mus musculus
tttcggcgaccgagccaccgagcaa

SEQ ID NO: 969716 - DNA, 25 bp, Mus musculus
tttcggcgaccgtgccaccgagcaa

SEQ ID NO: 969717 - DNA, 25 bp, Mus musculus
tttcggctatttctgtcccttccac

SEQ ID NO: 969718 - DNA, 25 bp, Mus musculus
tttcggctatttgtgtcccttccac

SEQ ID NO: 969719 - DNA, 25 bp, Mus musculus
tttcggctcatcatgcaggtggctc

SEQ ID NO: 969720 - DNA, 25 bp, Mus musculus
tttcggctcatcttgcaggtggctc

SEQ ID NO: 969721 - DNA, 25 bp, Mus musculus
tttcggcttccgatgagaacttaag

SEQ ID NO: 969722 - DNA, 25 bp, Mus musculus
tttcggcttccgttgagaacttaag

SEQ ID NO: 969723 - DNA, 25 bp, Mus musculus
tttcgggcatgtcgcaaggcttcat

SEQ ID NO: 969724 - DNA, 25 bp, Mus musculus
tttcgggcatgtggcaaggcttcat

SEQ ID NO: 969725 - DNA, 25 bp, Mus musculus
tttcgggcggagaccaaggagcctt

SEQ ID NO: 969726 - DNA, 25 bp, Mus musculus
tttcgggcggagtccaaggagcctt

SEQ ID NO: 969727 - DNA, 25 bp, Mus musculus
tttcgggctggtattggactcagag

SEQ ID NO: 969728 - DNA, 25 bp, Mus musculus
tttcgggctggttttggactcagag

SEQ ID NO: 969729 - DNA, 25 bp, Mus musculus
tttcggtacctacgcttccagtgat

SEQ ID NO: 969730 - DNA, 25 bp, Mus musculus
tttcggtacctaggcttccagtgat

SEQ ID NO: 969731 - DNA, 25 bp, Mus musculus
tttcggtcataacattttctttggg

SEQ ID NO: 969732 - DNA, 25 bp, Mus musculus
tttcggtcataagattttctttggg

SEQ ID NO: 969733 - DNA, 25 bp, Mus musculus
tttcggtgccttagtggccaaacac

SEQ ID NO: 969734 - DNA, 25 bp, Mus musculus
tttcggtgcctttgtggccaaacac

SEQ ID NO: 969735 - DNA, 25 bp, Mus musculus
tttcggtggcccatctctggcaaga

SEQ ID NO: 969736 - DNA, 25 bp, Mus musculus
tttcggtggcccttctctggcaaga

SEQ ID NO: 969737 - DNA, 25 bp, Mus musculus
tttcggtgtcagatgcttgtgccct

SEQ ID NO: 969738 - DNA, 25 bp, Mus musculus
tttcggtgtcagttgcttgtgccct

SEQ ID NO: 969739 - DNA, 25 bp, Mus musculus
tttcggtgtcccacatgtattgagc

SEQ ID NO: 969740 - DNA, 25 bp, Mus musculus
tttcggtgtccctcatgtattgagc

SEQ ID NO: 969741 - DNA, 25 bp, Mus musculus
tttcggttgtccatagacttgctga

SEQ ID NO: 969742 - DNA, 25 bp, Mus musculus
tttcggttgtccttagacttgctga

SEQ ID NO: 969743 - DNA, 25 bp, Mus musculus
tttcggtttgttagccacagcgatg

SEQ ID NO: 969744 - DNA, 25 bp, Mus musculus
tttcggtttgtttgccacagcgatg

SEQ ID NO: 969745 - DNA, 25 bp, Mus musculus
tttcgtacaccccaaactagtgctt

SEQ ID NO: 969746 - DNA, 25 bp, Mus musculus
tttcgtacacccgaaactagtgctt

SEQ ID NO: 969747 - DNA, 25 bp, Mus musculus
tttcgtaccatccacatcgaacctg

SEQ ID NO: 969748 - DNA, 25 bp, Mus musculus
tttcgtaccatcgacatcgaacctg

SEQ ID NO: 969749 - DNA, 25 bp, Mus musculus
tttcgtagctcaaataaagtccagt

SEQ ID NO: 969750 - DNA, 25 bp, Mus musculus
tttcgtagctcatataaagtccagt

SEQ ID NO: 969751 - DNA, 25 bp, Mus musculus
tttcgtaggcgacctactggaccgg

SEQ ID NO: 969752 - DNA, 25 bp, Mus musculus
tttcgtaggcgagctactggaccgg

SEQ ID NO: 969753 - DNA, 25 bp, Mus musculus
tttcgtagggctaaggagcaccagg

SEQ ID NO: 969754 - DNA, 25 bp, Mus musculus
tttcgtagggcttaggagcaccagg

SEQ ID NO: 969755 - DNA, 25 bp, Mus musculus
tttcgtcatcagacctcaaagcaga

SEQ ID NO: 969756 - DNA, 25 bp, Mus musculus
tttcgtcatcagtcctcaaagcaga

SEQ ID NO: 969757 - DNA, 25 bp, Mus musculus
tttcgtccacgtcaaccttatcaga

SEQ ID NO: 969758 - DNA, 25 bp, Mus musculus
tttcgtccacgtcctcgctgtaatc

SEQ ID NO: 969759 - DNA, 25 bp, Mus musculus
tttcgtccacgtgaaccttatcaga

SEQ ID NO: 969760 - DNA, 25 bp, Mus musculus
tttcgtccacgtgctcgctgtaatc

SEQ ID NO: 969761 - DNA, 25 bp, Mus musculus
tttcgtccagtaattcctcatgatg

SEQ ID NO: 969762 - DNA, 25 bp, Mus musculus
tttcgtccagtatttcctcatgatg

SEQ ID NO: 969763 - DNA, 25 bp, Mus musculus
tttcgtcctcctatactttgcaact

SEQ ID NO: 969764 - DNA, 25 bp, Mus musculus
tttcgtcctcctttactttgcaact

SEQ ID NO: 969765 - DNA, 25 bp, Mus musculus
tttcgtcctgatacttaacccttag

SEQ ID NO: 969766 - DNA, 25 bp, Mus musculus
tttcgtcctgattcttaacccttag

SEQ ID NO: 969767 - DNA, 25 bp, Mus musculus
tttcgtcctgtcatctgatcaccta

SEQ ID NO: 969768 - DNA, 25 bp, Mus musculus
tttcgtcctgtcttctgatcaccta

SEQ ID NO: 969769 - DNA, 25 bp, Mus musculus
tttcgtcctttgatcctgggcttta

SEQ ID NO: 969770 - DNA, 25 bp, Mus musculus
tttcgtcctttgttcctgggcttta

SEQ ID NO: 969771 - DNA, 25 bp, Mus musculus
tttcgtctatttatcaactaccagt

SEQ ID NO: 969772 - DNA, 25 bp, Mus musculus
tttcgtctatttttcaactaccagt

SEQ ID NO: 969773 - DNA, 25 bp, Mus musculus
tttcgtctcgctcgtggtttccagg

SEQ ID NO: 969774 - DNA, 25 bp, Mus musculus
tttcgtctcgctggtggtttccagg

SEQ ID NO: 969775 - DNA, 25 bp, Mus musculus
tttcgtcttccactcttgtacaata

SEQ ID NO: 969776 - DNA, 25 bp, Mus musculus
tttcgtcttccagtcttgtacaata

SEQ ID NO: 969777 - DNA, 25 bp, Mus musculus
tttcgtgacaatcccgtctgaactg

SEQ ID NO: 969778 - DNA, 25 bp, Mus musculus
tttcgtgacaatgccgtctgaactg

SEQ ID NO: 969779 - DNA, 25 bp, Mus musculus
tttcgtgacccacgagcacaatgtt

SEQ ID NO: 969780 - DNA, 25 bp, Mus musculus
tttcgtgacccaggagcacaatgtt

SEQ ID NO: 969781 - DNA, 25 bp, Mus musculus
tttcgtgaccctacatttccatgca

SEQ ID NO: 969782 - DNA, 25 bp, Mus musculus
tttcgtgacccttcatttccatgca

SEQ ID NO: 969783 - DNA, 25 bp, Mus musculus
tttcgtgattgccatgattcttccc

SEQ ID NO: 969784 - DNA, 25 bp, Mus musculus
tttcgtgattgcgatgattcttccc

SEQ ID NO: 969785 - DNA, 25 bp, Mus musculus
tttcgtgccctcctctgaagaagaa

SEQ ID NO: 969786 - DNA, 25 bp, Mus musculus
tttcgtgccctcgtctgaagaagaa

SEQ ID NO: 969787 - DNA, 25 bp, Mus musculus
tttcgtgccgatcgtctcacgcgcg

SEQ ID NO: 969788 - DNA, 25 bp, Mus musculus
tttcgtgccgatggtctcacgcgcg

SEQ ID NO: 969789 - DNA, 25 bp, Mus musculus
tttcgtggagatccaccccgcagat

SEQ ID NO: 969790 - DNA, 25 bp, Mus musculus
tttcgtggagatgcaccccgcagat

SEQ ID NO: 969791 - DNA, 25 bp, Mus musculus
tttcgtggcagcacttggccaatga

SEQ ID NO: 969792 - DNA, 25 bp, Mus musculus
tttcgtggcagctcttggccaatga

SEQ ID NO: 969793 - DNA, 25 bp, Mus musculus
tttcgtggccaaagttgaatcttat

SEQ ID NO: 969794 - DNA, 25 bp, Mus musculus
tttcgtggccaatgttgaatcttat

SEQ ID NO: 969795 - DNA, 25 bp, Mus musculus
tttcgtgtccaccaaagcagagatg

SEQ ID NO: 969796 - DNA, 25 bp, Mus musculus
tttcgtgtccacgaaagcagagatg

SEQ ID NO: 969797 - DNA, 25 bp, Mus musculus
tttcgtgtccgcactttgtgccatc

SEQ ID NO: 969798 - DNA, 25 bp, Mus musculus
tttcgtgtccgctctttgtgccatc

SEQ ID NO: 969799 - DNA, 25 bp, Mus musculus
tttcgtgtctccctaccaataaaat

SEQ ID NO: 969800 - DNA, 25 bp, Mus musculus
tttcgtgtctccgtaccaataaaat

SEQ ID NO: 969801 - DNA, 25 bp, Mus musculus
tttcgtgtttctagggatggaggtc

SEQ ID NO: 969802 - DNA, 25 bp, Mus musculus
tttcgtgtttcttgggatggaggtc

SEQ ID NO: 969803 - DNA, 25 bp, Mus musculus
tttcgttaagtcacaccctgtaagt

SEQ ID NO: 969804 - DNA, 25 bp, Mus musculus
tttcgttaagtctcaccctgtaagt

SEQ ID NO: 969805 - DNA, 25 bp, Mus musculus
tttcgttactctcctggacccagga

SEQ ID NO: 969806 - DNA, 25 bp, Mus musculus
tttcgttactctgctggacccagga

SEQ ID NO: 969807 - DNA, 25 bp, Mus musculus
tttcgttcaacacttcttgttacca

SEQ ID NO: 969808 - DNA, 25 bp, Mus musculus
tttcgttcaacagttcttgttacca

SEQ ID NO: 969809 - DNA, 25 bp, Mus musculus
tttcgttcccttcctctttgtggtt

SEQ ID NO: 969810 - DNA, 25 bp, Mus musculus
tttcgttcccttgctctttgtggtt

SEQ ID NO: 969811 - DNA, 25 bp, Mus musculus
tttcgttcctgacacacctatggaa

SEQ ID NO: 969812 - DNA, 25 bp, Mus musculus
tttcgttcctgagacacctatggaa

SEQ ID NO: 969813 - DNA, 25 bp, Mus musculus
tttcgttcctttagtctcactgaaa

SEQ ID NO: 969814 - DNA, 25 bp, Mus musculus
tttcgttccttttgtctcactgaaa

SEQ ID NO: 969815 - DNA, 25 bp, Mus musculus
tttcgttcgagccagtatctttgtt

SEQ ID NO: 969816 - DNA, 25 bp, Mus musculus
tttcgttcgagcgagtatctttgtt

SEQ ID NO: 969817 - DNA, 25 bp, Mus musculus
tttcgttgccttcgttcctgatgcc

SEQ ID NO: 969818 - DNA, 25 bp, Mus musculus
tttcgttgccttggttcctgatgcc

SEQ ID NO: 969819 - DNA, 25 bp, Mus musculus
tttcgtttttatcaagggccgtctg

SEQ ID NO: 969820 - DNA, 25 bp, Mus musculus
tttcgtttttatgaagggccgtctg

SEQ ID NO: 969821 - DNA, 25 bp, Mus musculus
tttctaaacacccttactggcacag

SEQ ID NO: 969822 - DNA, 25 bp, Mus musculus
tttctaaacaccgttactggcacag

SEQ ID NO: 969823 - DNA, 25 bp, Mus musculus
tttctaaaccaaattttacagtctg

SEQ ID NO: 969824 - DNA, 25 bp, Mus musculus
tttctaaaccaatttttacagtctg

SEQ ID NO: 969825 - DNA, 25 bp, Mus musculus
tttctaaagagacttctgggctgtt

SEQ ID NO: 969826 - DNA, 25 bp, Mus musculus
tttctaaagagagttctgggctgtt

SEQ ID NO: 969827 - DNA, 25 bp, Mus musculus
tttctaaaggtgcacggcctccgca

SEQ ID NO: 969828 - DNA, 25 bp, Mus musculus
tttctaaaggtggacggcctccgca

SEQ ID NO: 969829 - DNA, 25 bp, Mus musculus
tttctaaatggtcattctccccagc

SEQ ID NO: 969830 - DNA, 25 bp, Mus musculus
tttctaaatggtgattctccccagc

SEQ ID NO: 969831 - DNA, 25 bp, Mus musculus
tttctaaattagcaccctcacactg

SEQ ID NO: 969832 - DNA, 25 bp, Mus musculus
tttctaaattaggaccctcacactg

SEQ ID NO: 969833 - DNA, 25 bp, Mus musculus
tttctaaccacccacattacaatag

SEQ ID NO: 969834 - DNA, 25 bp, Mus musculus
tttctaaccaccgacattacaatag

SEQ ID NO: 969835 - DNA, 25 bp, Mus musculus
tttctaaccaggataccactgcacc

SEQ ID NO: 969836 - DNA, 25 bp, Mus musculus
tttctaaccaggttaccactgcacc

SEQ ID NO: 969837 - DNA, 25 bp, Mus musculus
tttctaaccccactctaggagtaat

SEQ ID NO: 969838 - DNA, 25 bp, Mus musculus
tttctaaccccagtctaggagtaat

SEQ ID NO: 969839 - DNA, 25 bp, Mus musculus
tttctaaccgtgacttgctatgcag

SEQ ID NO: 969840 - DNA, 25 bp, Mus musculus
tttctaaccgtgtcttgctatgcag

SEQ ID NO: 969841 - DNA, 25 bp, Mus musculus
tttctaactgcgagctttacagagg

SEQ ID NO: 969842 - DNA, 25 bp, Mus musculus
tttctaactgcgtgctttacagagg

SEQ ID NO: 969843 - DNA, 25 bp, Mus musculus
tttctaactggaaccgaactctggg

SEQ ID NO: 969844 - DNA, 25 bp, Mus musculus
tttctaactggatccgaactctggg

SEQ ID NO: 969845 - DNA, 25 bp, Mus musculus
tttctaagatgtcttgcagctcccc

SEQ ID NO: 969846 - DNA, 25 bp, Mus musculus
tttctaagatgtgttgcagctcccc

SEQ ID NO: 969847 - DNA, 25 bp, Mus musculus
tttctaagctgaacacttcgccact

SEQ ID NO: 969848 - DNA, 25 bp, Mus musculus
tttctaagctgatcacttcgccact

SEQ ID NO: 969849 - DNA, 25 bp, Mus musculus
tttctaaggcgccatgggagcatcc

SEQ ID NO: 969850 - DNA, 25 bp, Mus musculus
tttctaaggcgcgatgggagcatcc

SEQ ID NO: 969851 - DNA, 25 bp, Mus musculus
tttctaaggcgtctgtgtcaattca

SEQ ID NO: 969852 - DNA, 25 bp, Mus musculus
tttctaaggcgtgtgtgtcaattca

SEQ ID NO: 969853 - DNA, 25 bp, Mus musculus
tttctaagtcacacttcctgttgta

SEQ ID NO: 969854 - DNA, 25 bp, Mus musculus
tttctaagtcactcttcctgttgta

SEQ ID NO: 969855 - DNA, 25 bp, Mus musculus
tttctaagtcatagtagatctccag

SEQ ID NO: 969856 - DNA, 25 bp, Mus musculus
tttctaagtcattgtagatctccag

SEQ ID NO: 969857 - DNA, 25 bp, Mus musculus
tttctaagtgttaagaccttgttgg

SEQ ID NO: 969858 - DNA, 25 bp, Mus musculus
tttctaagtgtttagaccttgttgg

SEQ ID NO: 969859 - DNA, 25 bp, Mus musculus
tttctaataaacagagtttggacat

SEQ ID NO: 969860 - DNA, 25 bp, Mus musculus
tttctaataaactgagtttggacat

SEQ ID NO: 969861 - DNA, 25 bp, Mus musculus
tttctaatagacaagccacacccac

SEQ ID NO: 969862 - DNA, 25 bp, Mus musculus
tttctaatagactagccacacccac

SEQ ID NO: 969863 - DNA, 25 bp, Mus musculus
tttctaatctctcaaaattttttca

SEQ ID NO: 969864 - DNA, 25 bp, Mus musculus
tttctaatctctgaaaattttttca

SEQ ID NO: 969865 - DNA, 25 bp, Mus musculus
tttctaattagcattctctgcctca

SEQ ID NO: 969866 - DNA, 25 bp, Mus musculus
tttctaattagctttctctgcctca

SEQ ID NO: 969867 - DNA, 25 bp, Mus musculus
tttctaattataccccgattcagca

SEQ ID NO: 969868 - DNA, 25 bp, Mus musculus
tttctaattatagcccgattcagca

SEQ ID NO: 969869 - DNA, 25 bp, Mus musculus
tttctaatttctacctacctgctaa

SEQ ID NO: 969870 - DNA, 25 bp, Mus musculus
tttctaatttcttcctacctgctaa

SEQ ID NO: 969871 - DNA, 25 bp, Mus musculus
tttctaattttccttgcacccatag

SEQ ID NO: 969872 - DNA, 25 bp, Mus musculus
tttctaattttcgttgcacccatag

SEQ ID NO: 969873 - DNA, 25 bp, Mus musculus
tttctacaaccaagatcaagcccct

SEQ ID NO: 969874 - DNA, 25 bp, Mus musculus
tttctacaaccatgatcaagcccct

SEQ ID NO: 969875 - DNA, 25 bp, Mus musculus
tttctacaacgccttcactgtggtc

SEQ ID NO: 969876 - DNA, 25 bp, Mus musculus
tttctacaacgcgttcactgtggtc

SEQ ID NO: 969877 - DNA, 25 bp, Mus musculus
tttctacaatcaacttggaccccac

SEQ ID NO: 969878 - DNA, 25 bp, Mus musculus
tttctacaatcatcttggaccccac

SEQ ID NO: 969879 - DNA, 25 bp, Mus musculus
tttctacacactaggactgcttcag

SEQ ID NO: 969880 - DNA, 25 bp, Mus musculus
tttctacacactatatcatccactc

SEQ ID NO: 969881 - DNA, 25 bp, Mus musculus
tttctacacacttggactgcttcag

SEQ ID NO: 969882 - DNA, 25 bp, Mus musculus
tttctacacactttatcatccactc

SEQ ID NO: 969883 - DNA, 25 bp, Mus musculus
tttctacacccgagcagtggagaat

SEQ ID NO: 969884 - DNA, 25 bp, Mus musculus
tttctacacccgtgcagtggagaat

SEQ ID NO: 969885 - DNA, 25 bp, Mus musculus
tttctacactttatcatccgctaag

SEQ ID NO: 969886 - DNA, 25 bp, Mus musculus
tttctacactttttcatccgctaag

SEQ ID NO: 969887 - DNA, 25 bp, Mus musculus
tttctacagacaatctttgggatat

SEQ ID NO: 969888 - DNA, 25 bp, Mus musculus
tttctacagacattctttgggatat

SEQ ID NO: 969889 - DNA, 25 bp, Mus musculus
tttctacatccacccaatagagtct

SEQ ID NO: 969890 - DNA, 25 bp, Mus musculus
tttctacatccagccaatagagtct

SEQ ID NO: 969891 - DNA, 25 bp, Mus musculus
tttctacattcacgttttcctgcat

SEQ ID NO: 969892 - DNA, 25 bp, Mus musculus
tttctacattcaggttttcctgcat

SEQ ID NO: 969893 - DNA, 25 bp, Mus musculus
tttctacattccctaatccatcttt

SEQ ID NO: 969894 - DNA, 25 bp, Mus musculus
tttctacattccgtaatccatcttt

SEQ ID NO: 969895 - DNA, 25 bp, Mus musculus
tttctacattctacatgctcccctg

SEQ ID NO: 969896 - DNA, 25 bp, Mus musculus
tttctacattcttcatgctcccctg

SEQ ID NO: 969897 - DNA, 25 bp, Mus musculus
tttctaccacacagaacactctttc

SEQ ID NO: 969898 - DNA, 25 bp, Mus musculus
tttctaccacactgaacactctttc

SEQ ID NO: 969899 - DNA, 25 bp, Mus musculus
tttctaccacctaaaactcagattt

SEQ ID NO: 969900 - DNA, 25 bp, Mus musculus
tttctaccaccttaaactcagattt

SEQ ID NO: 969901 - DNA, 25 bp, Mus musculus
tttctaccactcattttggcagcaa

SEQ ID NO: 969902 - DNA, 25 bp, Mus musculus
tttctaccactctttttggcagcaa

SEQ ID NO: 969903 - DNA, 25 bp, Mus musculus
tttctaccatggacctgggtgtaca

SEQ ID NO: 969904 - DNA, 25 bp, Mus musculus
tttctaccatggtcctgggtgtaca

SEQ ID NO: 969905 - DNA, 25 bp, Mus musculus
tttctaccatgtattccacccaatc

SEQ ID NO: 969906 - DNA, 25 bp, Mus musculus
tttctaccatgtctggacgcggcaa

SEQ ID NO: 969907 - DNA, 25 bp, Mus musculus
tttctaccatgtgtggacgcggcaa

SEQ ID NO: 969908 - DNA, 25 bp, Mus musculus
tttctaccatgttttccacccaatc

SEQ ID NO: 969909 - DNA, 25 bp, Mus musculus
tttctacccaccctgctctgaatag

SEQ ID NO: 969910 - DNA, 25 bp, Mus musculus
tttctacccaccgtgctctgaatag

SEQ ID NO: 969911 - DNA, 25 bp, Mus musculus
tttctacccatgatgggaaaaactg

SEQ ID NO: 969912 - DNA, 25 bp, Mus musculus
tttctacccatgttgggaaaaactg

SEQ ID NO: 969913 - DNA, 25 bp, Mus musculus
tttctacccctactttctgtcatga

SEQ ID NO: 969914 - DNA, 25 bp, Mus musculus
tttctacccctagtttctgtcatga

SEQ ID NO: 969915 - DNA, 25 bp, Mus musculus
tttctaccgagacagcagggctagc

SEQ ID NO: 969916 - DNA, 25 bp, Mus musculus
tttctaccgagagagcagggctagc

SEQ ID NO: 969917 - DNA, 25 bp, Mus musculus
tttctaccgcagattcagacatgga

SEQ ID NO: 969918 - DNA, 25 bp, Mus musculus
tttctaccgcagtttcagacatgga

SEQ ID NO: 969919 - DNA, 25 bp, Mus musculus
tttctaccgccacttgcatgttaaa

SEQ ID NO: 969920 - DNA, 25 bp, Mus musculus
tttctaccgccagttgcatgttaaa

SEQ ID NO: 969921 - DNA, 25 bp, Mus musculus
tttctacctagtcctggacgggctt

SEQ ID NO: 969922 - DNA, 25 bp, Mus musculus
tttctacctagtgctggacgggctt

SEQ ID NO: 969923 - DNA, 25 bp, Mus musculus
tttctacctcatacttctatcttgt

SEQ ID NO: 969924 - DNA, 25 bp, Mus musculus
tttctacctcattcttctatcttgt

SEQ ID NO: 969925 - DNA, 25 bp, Mus musculus
tttctacctgtaatccaaagcatgt

SEQ ID NO: 969926 - DNA, 25 bp, Mus musculus
tttctacctgtattccaaagcatgt

SEQ ID NO: 969927 - DNA, 25 bp, Mus musculus
tttctacctgtgaatcttgctgcat

SEQ ID NO: 969928 - DNA, 25 bp, Mus musculus
tttctacctgtgtatcttgctgcat

SEQ ID NO: 969929 - DNA, 25 bp, Mus musculus
tttctacggttgcaaactgctgacc

SEQ ID NO: 969930 - DNA, 25 bp, Mus musculus
tttctacggttggaaactgctgacc

SEQ ID NO: 969931 - DNA, 25 bp, Mus musculus
tttctactacacattcttccatgtt

SEQ ID NO: 969932 - DNA, 25 bp, Mus musculus
tttctactacactttcttccatgtt

SEQ ID NO: 969933 - DNA, 25 bp, Mus musculus
tttctactaggccacccaaatatga

SEQ ID NO: 969934 - DNA, 25 bp, Mus musculus
tttctactaggcgacccaaatatga

SEQ ID NO: 969935 - DNA, 25 bp, Mus musculus
tttctactcagaattttggtgcttt

SEQ ID NO: 969936 - DNA, 25 bp, Mus musculus
tttctactcagatttttggtgcttt

SEQ ID NO: 969937 - DNA, 25 bp, Mus musculus
tttctactgagaatcaggcctcttc

SEQ ID NO: 969938 - DNA, 25 bp, Mus musculus
tttctactgagattcaggcctcttc

SEQ ID NO: 969939 - DNA, 25 bp, Mus musculus
tttctactgcctcgttgctgaagca

SEQ ID NO: 969940 - DNA, 25 bp, Mus musculus
tttctactgcctggttgctgaagca

SEQ ID NO: 969941 - DNA, 25 bp, Mus musculus
tttctactgctgagctgggaaaacg

SEQ ID NO: 969942 - DNA, 25 bp, Mus musculus
tttctactgctgatgccatccgtta

SEQ ID NO: 969943 - DNA, 25 bp, Mus musculus
tttctactgctgtgctgggaaaacg

SEQ ID NO: 969944 - DNA, 25 bp, Mus musculus
tttctactgctgttgccatccgtta

SEQ ID NO: 969945 - DNA, 25 bp, Mus musculus
tttctactggaccatagcctctcgg

SEQ ID NO: 969946 - DNA, 25 bp, Mus musculus
tttctactggacgatagcctctcgg

SEQ ID NO: 969947 - DNA, 25 bp, Mus musculus
tttctactggtaccttacgaacgag

SEQ ID NO: 969948 - DNA, 25 bp, Mus musculus
tttctactggtagcttacgaacgag

SEQ ID NO: 969949 - DNA, 25 bp, Mus musculus
tttctactgtataatggtggctctt

SEQ ID NO: 969950 - DNA, 25 bp, Mus musculus
tttctactgtattatggtggctctt

SEQ ID NO: 969951 - DNA, 25 bp, Mus musculus
tttctactgtgactttctgctcatt

SEQ ID NO: 969952 - DNA, 25 bp, Mus musculus
tttctactgtgagtttctgctcatt

SEQ ID NO: 969953 - DNA, 25 bp, Mus musculus
tttctactgtgtagctaaggacagt

SEQ ID NO: 969954 - DNA, 25 bp, Mus musculus
tttctactgtgttgctaaggacagt

SEQ ID NO: 969955 - DNA, 25 bp, Mus musculus
tttctactgttgcatctctgtggac

SEQ ID NO: 969956 - DNA, 25 bp, Mus musculus
tttctactgttggatctctgtggac

SEQ ID NO: 969957 - DNA, 25 bp, Mus musculus
tttctactgtttacccgagatgtca

SEQ ID NO: 969958 - DNA, 25 bp, Mus musculus
tttctactgtttattcccatcttgt

SEQ ID NO: 969959 - DNA, 25 bp, Mus musculus
tttctactgttttcccgagatgtca

SEQ ID NO: 969960 - DNA, 25 bp, Mus musculus
tttctactgttttttcccatcttgt

SEQ ID NO: 969961 - DNA, 25 bp, Mus musculus
tttctactttagacttctcttcggg

SEQ ID NO: 969962 - DNA, 25 bp, Mus musculus
tttctactttagtcttctcttcggg

SEQ ID NO: 969963 - DNA, 25 bp, Mus musculus
tttctactttccctgtttctacaga

SEQ ID NO: 969964 - DNA, 25 bp, Mus musculus
tttctactttccgtgtttctacaga

SEQ ID NO: 969965 - DNA, 25 bp, Mus musculus
tttctactttgccatgtgcctcatt

SEQ ID NO: 969966 - DNA, 25 bp, Mus musculus
tttctactttgcgatgtgcctcatt

SEQ ID NO: 969967 - DNA, 25 bp, Mus musculus
tttctacttttaatggactttatgt

SEQ ID NO: 969968 - DNA, 25 bp, Mus musculus
tttctacttttattggactttatgt

SEQ ID NO: 969969 - DNA, 25 bp, Mus musculus
tttctacttttcaccctaattattg

SEQ ID NO: 969970 - DNA, 25 bp, Mus musculus
tttctacttttctccctaattattg

SEQ ID NO: 969971 - DNA, 25 bp, Mus musculus
tttctagaaagcaccagtacgttta

SEQ ID NO: 969972 - DNA, 25 bp, Mus musculus
tttctagaaagctccagtacgttta

SEQ ID NO: 969973 - DNA, 25 bp, Mus musculus
tttctagaacaaaccaatagtggct

SEQ ID NO: 969974 - DNA, 25 bp, Mus musculus
tttctagaacaatccaatagtggct

SEQ ID NO: 969975 - DNA, 25 bp, Mus musculus
tttctagaatccagttcttccctca

SEQ ID NO: 969976 - DNA, 25 bp, Mus musculus
tttctagaatcctgttcttccctca

SEQ ID NO: 969977 - DNA, 25 bp, Mus musculus
tttctagaccatcgcgtgtcagtgt

SEQ ID NO: 969978 - DNA, 25 bp, Mus musculus
tttctagaccatggcgtgtcagtgt

SEQ ID NO: 969979 - DNA, 25 bp, Mus musculus
tttctagaccccaggcttaggcagg

SEQ ID NO: 969980 - DNA, 25 bp, Mus musculus
tttctagacccctggcttaggcagg

SEQ ID NO: 969981 - DNA, 25 bp, Mus musculus
tttctagaccgtaactgatttaatc

SEQ ID NO: 969982 - DNA, 25 bp, Mus musculus
tttctagaccgttactgatttaatc

SEQ ID NO: 969983 - DNA, 25 bp, Mus musculus
tttctagaggtcatagtgcttccaa

SEQ ID NO: 969984 - DNA, 25 bp, Mus musculus
tttctagaggtcttagtgcttccaa

SEQ ID NO: 969985 - DNA, 25 bp, Mus musculus
tttctagagtaaccccacttctgca

SEQ ID NO: 969986 - DNA, 25 bp, Mus musculus
tttctagagtaagcccacttctgca

SEQ ID NO: 969987 - DNA, 25 bp, Mus musculus
tttctagatgtgatcggcttcctac

SEQ ID NO: 969988 - DNA, 25 bp, Mus musculus
tttctagatgtgttcggcttcctac

SEQ ID NO: 969989 - DNA, 25 bp, Mus musculus
tttctagcaaagaccaagcgtgttc

SEQ ID NO: 969990 - DNA, 25 bp, Mus musculus
tttctagcaaagtccaagcgtgttc

SEQ ID NO: 969991 - DNA, 25 bp, Mus musculus
tttctagcacccctctgtaactgtt

SEQ ID NO: 969992 - DNA, 25 bp, Mus musculus
tttctagcacccgtctgtaactgtt

SEQ ID NO: 969993 - DNA, 25 bp, Mus musculus
tttctagcagagaggcatgccttct

SEQ ID NO: 969994 - DNA, 25 bp, Mus musculus
tttctagcagagtggcatgccttct

SEQ ID NO: 969995 - DNA, 25 bp, Mus musculus
tttctagccacaagctctgtacaca

SEQ ID NO: 969996 - DNA, 25 bp, Mus musculus
tttctagccacatgctctgtacaca

SEQ ID NO: 969997 - DNA, 25 bp, Mus musculus
tttctagcctctcctggtcatagac

SEQ ID NO: 969998 - DNA, 25 bp, Mus musculus
tttctagcctctgctggtcatagac

SEQ ID NO: 969999 - DNA, 25 bp, Mus musculus
tttctagctccaattccaaaccata

SEQ ID NO: 970000 - DNA, 25 bp, Mus musculus
tttctagctccatttccaaaccata

SEQ ID NO: 970001 - DNA, 25 bp, Mus musculus
tttctagctctacctagtttactct

SEQ ID NO: 970002 - DNA, 25 bp, Mus musculus
tttctagctctagctagtttactct

SEQ ID NO: 970003 - DNA, 25 bp, Mus musculus
tttctagctgctcttacatcaagag

SEQ ID NO: 970004 - DNA, 25 bp, Mus musculus
tttctagctgctgttacatcaagag

SEQ ID NO: 970005 - DNA, 25 bp, Mus musculus
tttctagctggtagggatttctcaa

SEQ ID NO: 970006 - DNA, 25 bp, Mus musculus
tttctagctggttgggatttctcaa

SEQ ID NO: 970007 - DNA, 25 bp, Mus musculus
tttctagctgttaaggtgggccatt

SEQ ID NO: 970008 - DNA, 25 bp, Mus musculus
tttctagctgtttaggtgggccatt

SEQ ID NO: 970009 - DNA, 25 bp, Mus musculus
tttctaggacctaggcgctgggcca

SEQ ID NO: 970010 - DNA, 25 bp, Mus musculus
tttctaggaccttggcgctgggcca

SEQ ID NO: 970011 - DNA, 25 bp, Mus musculus
tttctaggactcagtgcacctgttg

SEQ ID NO: 970012 - DNA, 25 bp, Mus musculus
tttctaggactctgtgcacctgttg

SEQ ID NO: 970013 - DNA, 25 bp, Mus musculus
tttctagggtccaactacaggatag

SEQ ID NO: 970014 - DNA, 25 bp, Mus musculus
tttctagggtcctactacaggatag

SEQ ID NO: 970015 - DNA, 25 bp, Mus musculus
tttctaggtcttacagagcctgttc

SEQ ID NO: 970016 - DNA, 25 bp, Mus musculus
tttctaggtctttcagagcctgttc

SEQ ID NO: 970017 - DNA, 25 bp, Mus musculus
tttctaggtgacaactttgggatcc

SEQ ID NO: 970018 - DNA, 25 bp, Mus musculus
tttctaggtgactactttgggatcc

SEQ ID NO: 970019 - DNA, 25 bp, Mus musculus
tttctaggtgatagctgccttctat

SEQ ID NO: 970020 - DNA, 25 bp, Mus musculus
tttctaggtgattgctgccttctat

SEQ ID NO: 970021 - DNA, 25 bp, Mus musculus
tttctagtacggcacatgagatgag

SEQ ID NO: 970022 - DNA, 25 bp, Mus musculus
tttctagtacgggacatgagatgag

SEQ ID NO: 970023 - DNA, 25 bp, Mus musculus
tttctagtagctataccactgaaga

SEQ ID NO: 970024 - DNA, 25 bp, Mus musculus
tttctagtagctttaccactgaaga

SEQ ID NO: 970025 - DNA, 25 bp, Mus musculus
tttctagtccaaagacttacttctt

SEQ ID NO: 970026 - DNA, 25 bp, Mus musculus
tttctagtccaatgacttacttctt

SEQ ID NO: 970027 - DNA, 25 bp, Mus musculus
tttctagtccatacttctgtacccc

SEQ ID NO: 970028 - DNA, 25 bp, Mus musculus
tttctagtccattcttctgtacccc

SEQ ID NO: 970029 - DNA, 25 bp, Mus musculus
tttctagtcctgattcactcccaag

SEQ ID NO: 970030 - DNA, 25 bp, Mus musculus
tttctagtcctgtttcactcccaag

SEQ ID NO: 970031 - DNA, 25 bp, Mus musculus
tttctagtctagcaaatgggcccct

SEQ ID NO: 970032 - DNA, 25 bp, Mus musculus
tttctagtctaggaaatgggcccct

SEQ ID NO: 970033 - DNA, 25 bp, Mus musculus
tttctagtgggactggcctgtcatc

SEQ ID NO: 970034 - DNA, 25 bp, Mus musculus
tttctagtgggagtggcctgtcatc

SEQ ID NO: 970035 - DNA, 25 bp, Mus musculus
tttctagtgtgcaactcatcttctg

SEQ ID NO: 970036 - DNA, 25 bp, Mus musculus
tttctagtgtgctactcatcttctg

SEQ ID NO: 970037 - DNA, 25 bp, Mus musculus
tttctagttaagctgtgcgttcagc

SEQ ID NO: 970038 - DNA, 25 bp, Mus musculus
tttctagttaaggtgtgcgttcagc

SEQ ID NO: 970039 - DNA, 25 bp, Mus musculus
tttctagttcggaaatccaggtgga

SEQ ID NO: 970040 - DNA, 25 bp, Mus musculus
tttctagttcggtaatccaggtgga

SEQ ID NO: 970041 - DNA, 25 bp, Mus musculus
tttctatacatgcatcctgcatctg

SEQ ID NO: 970042 - DNA, 25 bp, Mus musculus
tttctatacatggatcctgcatctg

SEQ ID NO: 970043 - DNA, 25 bp, Mus musculus
tttctataggaaagggagacaggcc

SEQ ID NO: 970044 - DNA, 25 bp, Mus musculus
tttctataggaatgggagacaggcc

SEQ ID NO: 970045 - DNA, 25 bp, Mus musculus
tttctatatactcggccacaaggct

SEQ ID NO: 970046 - DNA, 25 bp, Mus musculus
tttctatatactgggccacaaggct

SEQ ID NO: 970047 - DNA, 25 bp, Mus musculus
tttctatatagcattggccgtcctg

SEQ ID NO: 970048 - DNA, 25 bp, Mus musculus
tttctatatagctttggccgtcctg

SEQ ID NO: 970049 - DNA, 25 bp, Mus musculus
tttctatatcctcgctcacactgaa

SEQ ID NO: 970050 - DNA, 25 bp, Mus musculus
tttctatatcctggctcacactgaa

SEQ ID NO: 970051 - DNA, 25 bp, Mus musculus
tttctatcacttatgttggcatggg

SEQ ID NO: 970052 - DNA, 25 bp, Mus musculus
tttctatcacttttgttggcatggg

SEQ ID NO: 970053 - DNA, 25 bp, Mus musculus
tttctatcagtacagcagcagcaat

SEQ ID NO: 970054 - DNA, 25 bp, Mus musculus
tttctatcagtagagcagcagcaat

SEQ ID NO: 970055 - DNA, 25 bp, Mus musculus
tttctatcatggcacattgggcctg

SEQ ID NO: 970056 - DNA, 25 bp, Mus musculus
tttctatcatgggacattgggcctg

SEQ ID NO: 970057 - DNA, 25 bp, Mus musculus
tttctatccacaactcaggttgttc

SEQ ID NO: 970058 - DNA, 25 bp, Mus musculus
tttctatccacatctcaggttgttc

SEQ ID NO: 970059 - DNA, 25 bp, Mus musculus
tttctatccattcaacatttacccc

SEQ ID NO: 970060 - DNA, 25 bp, Mus musculus
tttctatccattgaacatttacccc

SEQ ID NO: 970061 - DNA, 25 bp, Mus musculus
tttctatcccctagggcataacgta

SEQ ID NO: 970062 - DNA, 25 bp, Mus musculus
tttctatccccttgggcataacgta

SEQ ID NO: 970063 - DNA, 25 bp, Mus musculus
tttctatcctacctattcctttact

SEQ ID NO: 970064 - DNA, 25 bp, Mus musculus
tttctatcctacgtattcctttact

SEQ ID NO: 970065 - DNA, 25 bp, Mus musculus
tttctatctcatcgacagaaattta

SEQ ID NO: 970066 - DNA, 25 bp, Mus musculus
tttctatctcatggacagaaattta

SEQ ID NO: 970067 - DNA, 25 bp, Mus musculus
tttctatctgaaaccaagcctttag

SEQ ID NO: 970068 - DNA, 25 bp, Mus musculus
tttctatctgaaatactccgcatat

SEQ ID NO: 970069 - DNA, 25 bp, Mus musculus
tttctatctgaatccaagcctttag

SEQ ID NO: 970070 - DNA, 25 bp, Mus musculus
tttctatctgaattactccgcatat

SEQ ID NO: 970071 - DNA, 25 bp, Mus musculus
tttctatctgccatctcagtgctgg

SEQ ID NO: 970072 - DNA, 25 bp, Mus musculus
tttctatctgccttctcagtgctgg

SEQ ID NO: 970073 - DNA, 25 bp, Mus musculus
tttctatctggacaacccctgagaa

SEQ ID NO: 970074 - DNA, 25 bp, Mus musculus
tttctatctggagaacccctgagaa

SEQ ID NO: 970075 - DNA, 25 bp, Mus musculus
tttctatcttttcccagtttctcaa

SEQ ID NO: 970076 - DNA, 25 bp, Mus musculus
tttctatcttttcgctagtgttctc

SEQ ID NO: 970077 - DNA, 25 bp, Mus musculus
tttctatcttttgccagtttctcaa

SEQ ID NO: 970078 - DNA, 25 bp, Mus musculus
tttctatcttttggctagtgttctc

SEQ ID NO: 970079 - DNA, 25 bp, Mus musculus
tttctatgacataacacccatttgt

SEQ ID NO: 970080 - DNA, 25 bp, Mus musculus
tttctatgacattacacccatttgt

SEQ ID NO: 970081 - DNA, 25 bp, Mus musculus
tttctatgatggataagggtgattc

SEQ ID NO: 970082 - DNA, 25 bp, Mus musculus
tttctatgatggttaagggtgattc

SEQ ID NO: 970083 - DNA, 25 bp, Mus musculus
tttctatgcagtcttctccccgatt

SEQ ID NO: 970084 - DNA, 25 bp, Mus musculus
tttctatgcagtgttctccccgatt

SEQ ID NO: 970085 - DNA, 25 bp, Mus musculus
tttctatgcatacgctctgggtcat

SEQ ID NO: 970086 - DNA, 25 bp, Mus musculus
tttctatgcataggctctgggtcat

SEQ ID NO: 970087 - DNA, 25 bp, Mus musculus
tttctatggcagacccaggatctca

SEQ ID NO: 970088 - DNA, 25 bp, Mus musculus
tttctatggcagtcccaggatctca

SEQ ID NO: 970089 - DNA, 25 bp, Mus musculus
tttctatggccacgactctctgatg

SEQ ID NO: 970090 - DNA, 25 bp, Mus musculus
tttctatggccaggactctctgatg

SEQ ID NO: 970091 - DNA, 25 bp, Mus musculus
tttctattattgatctatgagtaag

SEQ ID NO: 970092 - DNA, 25 bp, Mus musculus
tttctattattgttctatgagtaag

SEQ ID NO: 970093 - DNA, 25 bp, Mus musculus
tttctattcccaattacctagtgtt

SEQ ID NO: 970094 - DNA, 25 bp, Mus musculus
tttctattcccatttacctagtgtt

SEQ ID NO: 970095 - DNA, 25 bp, Mus musculus
tttctattctaaaagtccatgttgc

SEQ ID NO: 970096 - DNA, 25 bp, Mus musculus
tttctattctaatagtccatgttgc

SEQ ID NO: 970097 - DNA, 25 bp, Mus musculus
tttctattctacacactggaacttt

SEQ ID NO: 970098 - DNA, 25 bp, Mus musculus
tttctattctactcactggaacttt

SEQ ID NO: 970099 - DNA, 25 bp, Mus musculus
tttctattctgactcatccatcaag

SEQ ID NO: 970100 - DNA, 25 bp, Mus musculus
tttctattctgagtcatccatcaag

SEQ ID NO: 970101 - DNA, 25 bp, Mus musculus
tttctattgacaacggccttctgac

SEQ ID NO: 970102 - DNA, 25 bp, Mus musculus
tttctattgacatcggccttctgac

SEQ ID NO: 970103 - DNA, 25 bp, Mus musculus
tttctattgctgatgatgtgggatc

SEQ ID NO: 970104 - DNA, 25 bp, Mus musculus
tttctattgctgttgatgtgggatc

SEQ ID NO: 970105 - DNA, 25 bp, Mus musculus
tttctattggtcattgttctgtgca

SEQ ID NO: 970106 - DNA, 25 bp, Mus musculus
tttctattggtctttgttctgtgca

SEQ ID NO: 970107 - DNA, 25 bp, Mus musculus
tttctattgtatcttttcggttaag

SEQ ID NO: 970108 - DNA, 25 bp, Mus musculus
tttctattgtatgttttcggttaag

SEQ ID NO: 970109 - DNA, 25 bp, Mus musculus
tttctatttcagagttcagaagctc

SEQ ID NO: 970110 - DNA, 25 bp, Mus musculus
tttctatttcagtgttcagaagctc

SEQ ID NO: 970111 - DNA, 25 bp, Mus musculus
tttctatttccaatatttgctgaag

SEQ ID NO: 970112 - DNA, 25 bp, Mus musculus
tttctatttccattatttgctgaag

SEQ ID NO: 970113 - DNA, 25 bp, Mus musculus
tttctattttacactgcttcgttcc

SEQ ID NO: 970114 - DNA, 25 bp, Mus musculus
tttctattttactctgcttcgttcc

SEQ ID NO: 970115 - DNA, 25 bp, Mus musculus
tttctcaaaaatatgccctcagatt

SEQ ID NO: 970116 - DNA, 25 bp, Mus musculus
tttctcaaaaatttgccctcagatt

SEQ ID NO: 970117 - DNA, 25 bp, Mus musculus
tttctcaaacctctggccacctaga

SEQ ID NO: 970118 - DNA, 25 bp, Mus musculus
tttctcaaacctgtggccacctaga

SEQ ID NO: 970119 - DNA, 25 bp, Mus musculus
tttctcaaagagctacgggcacaga

SEQ ID NO: 970120 - DNA, 25 bp, Mus musculus
tttctcaaagaggtacgggcacaga

SEQ ID NO: 970121 - DNA, 25 bp, Mus musculus
tttctcaaataaatcaaggctgcat

SEQ ID NO: 970122 - DNA, 25 bp, Mus musculus
tttctcaaataattcaaggctgcat

SEQ ID NO: 970123 - DNA, 25 bp, Mus musculus
tttctcaaatatcttgcttcccctg

SEQ ID NO: 970124 - DNA, 25 bp, Mus musculus
tttctcaaatatgttgcttcccctg

SEQ ID NO: 970125 - DNA, 25 bp, Mus musculus
tttctcaacatgattgtcccattcc

SEQ ID NO: 970126 - DNA, 25 bp, Mus musculus
tttctcaacatgtttgtcccattcc

SEQ ID NO: 970127 - DNA, 25 bp, Mus musculus
tttctcaagaaacactgcaactgtt

SEQ ID NO: 970128 - DNA, 25 bp, Mus musculus
tttctcaagaaagactgcaactgtt

SEQ ID NO: 970129 - DNA, 25 bp, Mus musculus
tttctcaagaatccacataccctag

SEQ ID NO: 970130 - DNA, 25 bp, Mus musculus
tttctcaagaatgcacataccctag

SEQ ID NO: 970131 - DNA, 25 bp, Mus musculus
tttctcaagctcatcctttaagcag

SEQ ID NO: 970132 - DNA, 25 bp, Mus musculus
tttctcaagctcttcctttaagcag

SEQ ID NO: 970133 - DNA, 25 bp, Mus musculus
tttctcaaggtgatcactggagccc

SEQ ID NO: 970134 - DNA, 25 bp, Mus musculus
tttctcaaggtgttcactggagccc

SEQ ID NO: 970135 - DNA, 25 bp, Mus musculus
tttctcaagtaaactggctccaccc

SEQ ID NO: 970136 - DNA, 25 bp, Mus musculus
tttctcaagtaatctggctccaccc

SEQ ID NO: 970137 - DNA, 25 bp, Mus musculus
tttctcaagtccagacattcttctc

SEQ ID NO: 970138 - DNA, 25 bp, Mus musculus
tttctcaagtcctgacattcttctc

SEQ ID NO: 970139 - DNA, 25 bp, Mus musculus
tttctcaatctcagtagcatgactt

SEQ ID NO: 970140 - DNA, 25 bp, Mus musculus
tttctcaatctctgtagcatgactt

SEQ ID NO: 970141 - DNA, 25 bp, Mus musculus
tttctcaatgtcatttgctttcaga

SEQ ID NO: 970142 - DNA, 25 bp, Mus musculus
tttctcaatgtcttttgctttcaga

SEQ ID NO: 970143 - DNA, 25 bp, Mus musculus
tttctcaattcacctggcgtagtgt

SEQ ID NO: 970144 - DNA, 25 bp, Mus musculus
tttctcaattcagctggcgtagtgt

SEQ ID NO: 970145 - DNA, 25 bp, Mus musculus
tttctcacacataccagggtctcat

SEQ ID NO: 970146 - DNA, 25 bp, Mus musculus
tttctcacacattccagggtctcat

SEQ ID NO: 970147 - DNA, 25 bp, Mus musculus
tttctcacacgtctctttaaggcgt

SEQ ID NO: 970148 - DNA, 25 bp, Mus musculus
tttctcacacgtgtctttaaggcgt

SEQ ID NO: 970149 - DNA, 25 bp, Mus musculus
tttctcacagctcctagagacggac

SEQ ID NO: 970150 - DNA, 25 bp, Mus musculus
tttctcacagctgctagagacggac

SEQ ID NO: 970151 - DNA, 25 bp, Mus musculus
tttctcacagttctaaggcaggttc

SEQ ID NO: 970152 - DNA, 25 bp, Mus musculus
tttctcacagttgtaaggcaggttc

SEQ ID NO: 970153 - DNA, 25 bp, Mus musculus
tttctcacatctctaccggccaaat

SEQ ID NO: 970154 - DNA, 25 bp, Mus musculus
tttctcacatctgtaccggccaaat

SEQ ID NO: 970155 - DNA, 25 bp, Mus musculus
tttctcacatgaatatcaccccagg

SEQ ID NO: 970156 - DNA, 25 bp, Mus musculus
tttctcacatgattatcaccccagg

SEQ ID NO: 970157 - DNA, 25 bp, Mus musculus
tttctcacatgcaatcagtctgtgt

SEQ ID NO: 970158 - DNA, 25 bp, Mus musculus
tttctcacatgctatcagtctgtgt

SEQ ID NO: 970159 - DNA, 25 bp, Mus musculus
tttctcaccagcctctgaatgacat

SEQ ID NO: 970160 - DNA, 25 bp, Mus musculus
tttctcaccagcgtctgaatgacat

SEQ ID NO: 970161 - DNA, 25 bp, Mus musculus
tttctcacccccctgtatggacatt

SEQ ID NO: 970162 - DNA, 25 bp, Mus musculus
tttctcacccccgtgtatggacatt

SEQ ID NO: 970163 - DNA, 25 bp, Mus musculus
tttctcaccgatatctcccgttata

SEQ ID NO: 970164 - DNA, 25 bp, Mus musculus
tttctcaccgatttctcccgttata

SEQ ID NO: 970165 - DNA, 25 bp, Mus musculus
tttctcaccttaatgtgcaccagag

SEQ ID NO: 970166 - DNA, 25 bp, Mus musculus
tttctcaccttattgtgcaccagag

SEQ ID NO: 970167 - DNA, 25 bp, Mus musculus
tttctcactcttcatagcctttgca

SEQ ID NO: 970168 - DNA, 25 bp, Mus musculus
tttctcactcttgatagcctttgca

SEQ ID NO: 970169 - DNA, 25 bp, Mus musculus
tttctcactgcaaacgtggagttca

SEQ ID NO: 970170 - DNA, 25 bp, Mus musculus
tttctcactgcatacgtggagttca

SEQ ID NO: 970171 - DNA, 25 bp, Mus musculus
tttctcacttgacctcctgggatat

SEQ ID NO: 970172 - DNA, 25 bp, Mus musculus
tttctcacttgagctcctgggatat

SEQ ID NO: 970173 - DNA, 25 bp, Mus musculus
tttctcagaattaacactcatttgc

SEQ ID NO: 970174 - DNA, 25 bp, Mus musculus
tttctcagaatttacactcatttgc

SEQ ID NO: 970175 - DNA, 25 bp, Mus musculus
tttctcagagaacgctctgtcggcg

SEQ ID NO: 970176 - DNA, 25 bp, Mus musculus
tttctcagagaaggctctgtcggcg

SEQ ID NO: 970177 - DNA, 25 bp, Mus musculus
tttctcagaggcctgtcctcagaca

SEQ ID NO: 970178 - DNA, 25 bp, Mus musculus
tttctcagaggcgtgtcctcagaca

SEQ ID NO: 970179 - DNA, 25 bp, Mus musculus
tttctcagatccaactctttaattg

SEQ ID NO: 970180 - DNA, 25 bp, Mus musculus
tttctcagatcctactctttaattg

SEQ ID NO: 970181 - DNA, 25 bp, Mus musculus
tttctcagccagaaattccacattc

SEQ ID NO: 970182 - DNA, 25 bp, Mus musculus
tttctcagccagtaattccacattc

SEQ ID NO: 970183 - DNA, 25 bp, Mus musculus
tttctcagccccagagcaaatccag

SEQ ID NO: 970184 - DNA, 25 bp, Mus musculus
tttctcagcccctgagcaaatccag

SEQ ID NO: 970185 - DNA, 25 bp, Mus musculus
tttctcagccgacgtgaagcccact

SEQ ID NO: 970186 - DNA, 25 bp, Mus musculus
tttctcagccgaggtgaagcccact

SEQ ID NO: 970187 - DNA, 25 bp, Mus musculus
tttctcagcgttcttttctgggcaa

SEQ ID NO: 970188 - DNA, 25 bp, Mus musculus
tttctcagcgttgttttctgggcaa

SEQ ID NO: 970189 - DNA, 25 bp, Mus musculus
tttctcaggagcacagatctttctc

SEQ ID NO: 970190 - DNA, 25 bp, Mus musculus
tttctcaggagctcagatctttctc

SEQ ID NO: 970191 - DNA, 25 bp, Mus musculus
tttctcaggcacctgaggcccatgg

SEQ ID NO: 970192 - DNA, 25 bp, Mus musculus
tttctcaggcacgtgaggcccatgg

SEQ ID NO: 970193 - DNA, 25 bp, Mus musculus
tttctcaggcctaggaggaccagga

SEQ ID NO: 970194 - DNA, 25 bp, Mus musculus
tttctcaggccttggaggaccagga

SEQ ID NO: 970195 - DNA, 25 bp, Mus musculus
tttctcaggctgacttttggcaaag

SEQ ID NO: 970196 - DNA, 25 bp, Mus musculus
tttctcaggctgtcttttggcaaag

SEQ ID NO: 970197 - DNA, 25 bp, Mus musculus
tttctcagggaacctatgcgggaat

SEQ ID NO: 970198 - DNA, 25 bp, Mus musculus
tttctcagggaagctatgcgggaat

SEQ ID NO: 970199 - DNA, 25 bp, Mus musculus
tttctcagggtcattcttcccatgc

SEQ ID NO: 970200 - DNA, 25 bp, Mus musculus
tttctcagggtctttcttcccatgc

SEQ ID NO: 970201 - DNA, 25 bp, Mus musculus
tttctcaggtgaaatgagtcacgtg

SEQ ID NO: 970202 - DNA, 25 bp, Mus musculus
tttctcaggtgatatgagtcacgtg

SEQ ID NO: 970203 - DNA, 25 bp, Mus musculus
tttctcaggtgtactccggtgcaca

SEQ ID NO: 970204 - DNA, 25 bp, Mus musculus
tttctcaggtgttctccggtgcaca

SEQ ID NO: 970205 - DNA, 25 bp, Mus musculus
tttctcagtgagctttccttcttcc

SEQ ID NO: 970206 - DNA, 25 bp, Mus musculus
tttctcagtgaggtttccttcttcc

SEQ ID NO: 970207 - DNA, 25 bp, Mus musculus
tttctcagttgaaattctctctttc

SEQ ID NO: 970208 - DNA, 25 bp, Mus musculus
tttctcagttgatattctctctttc

SEQ ID NO: 970209 - DNA, 25 bp, Mus musculus
tttctcagttggatctgtccagcaa

SEQ ID NO: 970210 - DNA, 25 bp, Mus musculus
tttctcagttggttctgtccagcaa

SEQ ID NO: 970211 - DNA, 25 bp, Mus musculus
tttctcagtttcatgcaccttaaag

SEQ ID NO: 970212 - DNA, 25 bp, Mus musculus
tttctcagtttcttgcaccttaaag

SEQ ID NO: 970213 - DNA, 25 bp, Mus musculus
tttctcatacaccaatgacaggaat

SEQ ID NO: 970214 - DNA, 25 bp, Mus musculus
tttctcatacacgaatgacaggaat

SEQ ID NO: 970215 - DNA, 25 bp, Mus musculus
tttctcatcagcatgcctgctacca

SEQ ID NO: 970216 - DNA, 25 bp, Mus musculus
tttctcatcagcttgcctgctacca

SEQ ID NO: 970217 - DNA, 25 bp, Mus musculus
tttctcatcatcactaggtctttct

SEQ ID NO: 970218 - DNA, 25 bp, Mus musculus
tttctcatcatctctaggtctttct

SEQ ID NO: 970219 - DNA, 25 bp, Mus musculus
tttctcatccaccaaaatgcacgac

SEQ ID NO: 970220 - DNA, 25 bp, Mus musculus
tttctcatccacgaaaatgcacgac

SEQ ID NO: 970221 - DNA, 25 bp, Mus musculus
tttctcatccatcatacctatgcat

SEQ ID NO: 970222 - DNA, 25 bp, Mus musculus
tttctcatccatgatacctatgcat

SEQ ID NO: 970223 - DNA, 25 bp, Mus musculus
tttctcatctacaacctattccagg

SEQ ID NO: 970224 - DNA, 25 bp, Mus musculus
tttctcatctactacctattccagg

SEQ ID NO: 970225 - DNA, 25 bp, Mus musculus
tttctcatctctctcggtcaatggt

SEQ ID NO: 970226 - DNA, 25 bp, Mus musculus
tttctcatctctgtcggtcaatggt

SEQ ID NO: 970227 - DNA, 25 bp, Mus musculus
tttctcatcttgctactactctggg

SEQ ID NO: 970228 - DNA, 25 bp, Mus musculus
tttctcatcttggtactactctggg

SEQ ID NO: 970229 - DNA, 25 bp, Mus musculus
tttctcatgaaaacgctcagccagg

SEQ ID NO: 970230 - DNA, 25 bp, Mus musculus
tttctcatgaaatcgctcagccagg

SEQ ID NO: 970231 - DNA, 25 bp, Mus musculus
tttctcatgactcaagcccggcaac

SEQ ID NO: 970232 - DNA, 25 bp, Mus musculus
tttctcatgactgaagcccggcaac

SEQ ID NO: 970233 - DNA, 25 bp, Mus musculus
tttctcatgatgaaccccaagcacc

SEQ ID NO: 970234 - DNA, 25 bp, Mus musculus
tttctcatgatgtaccccaagcacc

SEQ ID NO: 970235 - DNA, 25 bp, Mus musculus
tttctcatgcctcgtactagggcat

SEQ ID NO: 970236 - DNA, 25 bp, Mus musculus
tttctcatgcctggtactagggcat

SEQ ID NO: 970237 - DNA, 25 bp, Mus musculus
tttctcatgctgacgagcgaccttt

SEQ ID NO: 970238 - DNA, 25 bp, Mus musculus
tttctcatgctgtcgagcgaccttt

SEQ ID NO: 970239 - DNA, 25 bp, Mus musculus
tttctcatggagctgtgaacaaaca

SEQ ID NO: 970240 - DNA, 25 bp, Mus musculus
tttctcatggaggtgtgaacaaaca

SEQ ID NO: 970241 - DNA, 25 bp, Mus musculus
tttctcatgttcaccgcgtacctca

SEQ ID NO: 970242 - DNA, 25 bp, Mus musculus
tttctcatgttctccgcgtacctca

SEQ ID NO: 970243 - DNA, 25 bp, Mus musculus
tttctcattagaatttcccttggta

SEQ ID NO: 970244 - DNA, 25 bp, Mus musculus
tttctcattagattttcccttggta

SEQ ID NO: 970245 - DNA, 25 bp, Mus musculus
tttctcattcctattcatgttcaaa

SEQ ID NO: 970246 - DNA, 25 bp, Mus musculus
tttctcattccttttcatgttcaaa

SEQ ID NO: 970247 - DNA, 25 bp, Mus musculus
tttctcattcgaattctcaggattc

SEQ ID NO: 970248 - DNA, 25 bp, Mus musculus
tttctcattcgatttctcaggattc

SEQ ID NO: 970249 - DNA, 25 bp, Mus musculus
tttctcattctgatctattatgtcc

SEQ ID NO: 970250 - DNA, 25 bp, Mus musculus
tttctcattctgttctattatgtcc

SEQ ID NO: 970251 - DNA, 25 bp, Mus musculus
tttctcattgagactaacctaattt

SEQ ID NO: 970252 - DNA, 25 bp, Mus musculus
tttctcattgagtctaacctaattt

SEQ ID NO: 970253 - DNA, 25 bp, Mus musculus
tttctcattgtaaacccacctattc

SEQ ID NO: 970254 - DNA, 25 bp, Mus musculus
tttctcattgtatacccacctattc

SEQ ID NO: 970255 - DNA, 25 bp, Mus musculus
tttctcattgtcattttgcatcaag

SEQ ID NO: 970256 - DNA, 25 bp, Mus musculus
tttctcattgtctttttgcatcaag

SEQ ID NO: 970257 - DNA, 25 bp, Mus musculus
tttctcattgttatcccaggcttta

SEQ ID NO: 970258 - DNA, 25 bp, Mus musculus
tttctcattgttttcccaggcttta

SEQ ID NO: 970259 - DNA, 25 bp, Mus musculus
tttctcatttctcacccacgggaga

SEQ ID NO: 970260 - DNA, 25 bp, Mus musculus
tttctcatttctgacccacgggaga

SEQ ID NO: 970261 - DNA, 25 bp, Mus musculus
tttctccaaaccacttgacttcatc

SEQ ID NO: 970262 - DNA, 25 bp, Mus musculus
tttctccaaacctcttgacttcatc

SEQ ID NO: 970263 - DNA, 25 bp, Mus musculus
tttctccaaaggctagggagcccag

SEQ ID NO: 970264 - DNA, 25 bp, Mus musculus
tttctccaaagggtagggagcccag

SEQ ID NO: 970265 - DNA, 25 bp, Mus musculus
tttctccaaatcacttctgactgtc

SEQ ID NO: 970266 - DNA, 25 bp, Mus musculus
tttctccaaatccagcctgaccaag

SEQ ID NO: 970267 - DNA, 25 bp, Mus musculus
tttctccaaatcgagcctgaccaag

SEQ ID NO: 970268 - DNA, 25 bp, Mus musculus
tttctccaaatctcttctgactgtc

SEQ ID NO: 970269 - DNA, 25 bp, Mus musculus
tttctccaacagacacaagcactag

SEQ ID NO: 970270 - DNA, 25 bp, Mus musculus
tttctccaacagtcacaagcactag

SEQ ID NO: 970271 - DNA, 25 bp, Mus musculus
tttctccaactccagacaacatttc

SEQ ID NO: 970272 - DNA, 25 bp, Mus musculus
tttctccaactcgagacaacatttc

SEQ ID NO: 970273 - DNA, 25 bp, Mus musculus
tttctccaagaaatagggctagccg

SEQ ID NO: 970274 - DNA, 25 bp, Mus musculus
tttctccaagaattagggctagccg

SEQ ID NO: 970275 - DNA, 25 bp, Mus musculus
tttctccaagtacaagccatcacgc

SEQ ID NO: 970276 - DNA, 25 bp, Mus musculus
tttctccaagtagaagccatcacgc

SEQ ID NO: 970277 - DNA, 25 bp, Mus musculus
tttctccaatggaaggtgtatgcat

SEQ ID NO: 970278 - DNA, 25 bp, Mus musculus
tttctccaatggtaggtgtatgcat

SEQ ID NO: 970279 - DNA, 25 bp, Mus musculus
tttctccacattctaatccatgcct

SEQ ID NO: 970280 - DNA, 25 bp, Mus musculus
tttctccacattgtaatccatgcct

SEQ ID NO: 970281 - DNA, 25 bp, Mus musculus
tttctccaccaccaaggcatagtca

SEQ ID NO: 970282 - DNA, 25 bp, Mus musculus
tttctccaccacgaaggcatagtca

SEQ ID NO: 970283 - DNA, 25 bp, Mus musculus
tttctccacgcacatcttagcttaa

SEQ ID NO: 970284 - DNA, 25 bp, Mus musculus
tttctccacgcagatcttagcttaa

SEQ ID NO: 970285 - DNA, 25 bp, Mus musculus
tttctccactggattctcaacagta

SEQ ID NO: 970286 - DNA, 25 bp, Mus musculus
tttctccactggctcaaagccaact

SEQ ID NO: 970287 - DNA, 25 bp, Mus musculus
tttctccactggctgcagatcctag

SEQ ID NO: 970288 - DNA, 25 bp, Mus musculus
tttctccactgggtcaaagccaact

SEQ ID NO: 970289 - DNA, 25 bp, Mus musculus
tttctccactgggtgcagatcctag

SEQ ID NO: 970290 - DNA, 25 bp, Mus musculus
tttctccactggtttctcaacagta

SEQ ID NO: 970291 - DNA, 25 bp, Mus musculus
tttctccagccacctaccgaatttg

SEQ ID NO: 970292 - DNA, 25 bp, Mus musculus
tttctccagccagctaccgaatttg

SEQ ID NO: 970293 - DNA, 25 bp, Mus musculus
tttctccagctcctcaaagaagtaa

SEQ ID NO: 970294 - DNA, 25 bp, Mus musculus
tttctccagctcgtcaaagaagtaa

SEQ ID NO: 970295 - DNA, 25 bp, Mus musculus
tttctccaggtaaggtggccacgct

SEQ ID NO: 970296 - DNA, 25 bp, Mus musculus
tttctccaggtatggtggccacgct

SEQ ID NO: 970297 - DNA, 25 bp, Mus musculus
tttctccaggtgcttgcagccagtc

SEQ ID NO: 970298 - DNA, 25 bp, Mus musculus
tttctccaggtggttgcagccagtc

SEQ ID NO: 970299 - DNA, 25 bp, Mus musculus
tttctccatatgacttcaactggca

SEQ ID NO: 970300 - DNA, 25 bp, Mus musculus
tttctccatatgtcttcaactggca

SEQ ID NO: 970301 - DNA, 25 bp, Mus musculus
tttctccatattacattttatcttg

SEQ ID NO: 970302 - DNA, 25 bp, Mus musculus
tttctccatatttcattttatcttg

SEQ ID NO: 970303 - DNA, 25 bp, Mus musculus
tttctccatcagctatgaccacggg

SEQ ID NO: 970304 - DNA, 25 bp, Mus musculus
tttctccatcaggtatgaccacggg

SEQ ID NO: 970305 - DNA, 25 bp, Mus musculus
tttctccatgtgacaccaagtgaag

SEQ ID NO: 970306 - DNA, 25 bp, Mus musculus
tttctccatgtgtcaccaagtgaag

SEQ ID NO: 970307 - DNA, 25 bp, Mus musculus
tttctcccaacaccttttgaatttg

SEQ ID NO: 970308 - DNA, 25 bp, Mus musculus
tttctcccaacagcttttgaatttg

SEQ ID NO: 970309 - DNA, 25 bp, Mus musculus
tttctcccaactattgacattaagg

SEQ ID NO: 970310 - DNA, 25 bp, Mus musculus
tttctcccaacttttgacattaagg

SEQ ID NO: 970311 - DNA, 25 bp, Mus musculus
tttctcccaagcattatgttcttgg

SEQ ID NO: 970312 - DNA, 25 bp, Mus musculus
tttctcccaagcctcttttgggagg

SEQ ID NO: 970313 - DNA, 25 bp, Mus musculus
tttctcccaagcgtcttttgggagg

SEQ ID NO: 970314 - DNA, 25 bp, Mus musculus
tttctcccaagctttatgttcttgg

SEQ ID NO: 970315 - DNA, 25 bp, Mus musculus
tttctcccacagacacggttaggaa

SEQ ID NO: 970316 - DNA, 25 bp, Mus musculus
tttctcccacagtcacggttaggaa

SEQ ID NO: 970317 - DNA, 25 bp, Mus musculus
tttctcccactaattttggcatctg

SEQ ID NO: 970318 - DNA, 25 bp, Mus musculus
tttctcccactatttttggcatctg

SEQ ID NO: 970319 - DNA, 25 bp, Mus musculus
tttctccccaatctgtgtgtttata

SEQ ID NO: 970320 - DNA, 25 bp, Mus musculus
tttctccccaatgtgtgtgtttata

SEQ ID NO: 970321 - DNA, 25 bp, Mus musculus
tttctccccagaaaaacagtaatgc

SEQ ID NO: 970322 - DNA, 25 bp, Mus musculus
tttctccccagataaacagtaatgc

SEQ ID NO: 970323 - DNA, 25 bp, Mus musculus
tttctccccaggaggtgatactatg

SEQ ID NO: 970324 - DNA, 25 bp, Mus musculus
tttctccccaggtggtgatactatg

SEQ ID NO: 970325 - DNA, 25 bp, Mus musculus
tttctccccattaaaacctgagctg

SEQ ID NO: 970326 - DNA, 25 bp, Mus musculus
tttctccccatttaaacctgagctg

SEQ ID NO: 970327 - DNA, 25 bp, Mus musculus
tttctcccctacagtgatgacgatc

SEQ ID NO: 970328 - DNA, 25 bp, Mus musculus
tttctcccctactgtgatgacgatc

SEQ ID NO: 970329 - DNA, 25 bp, Mus musculus
tttctccccttaaactgtcatgaga

SEQ ID NO: 970330 - DNA, 25 bp, Mus musculus
tttctccccttaaagacctgcattt

SEQ ID NO: 970331 - DNA, 25 bp, Mus musculus
tttctccccttatactgtcatgaga

SEQ ID NO: 970332 - DNA, 25 bp, Mus musculus
tttctccccttatagacctgcattt

SEQ ID NO: 970333 - DNA, 25 bp, Mus musculus
tttctcccgaccattgtgtaaactg

SEQ ID NO: 970334 - DNA, 25 bp, Mus musculus
tttctcccgacctttgtgtaaactg

SEQ ID NO: 970335 - DNA, 25 bp, Mus musculus
tttctcccgccaatatttctgaatg

SEQ ID NO: 970336 - DNA, 25 bp, Mus musculus
tttctcccgccattatttctgaatg

SEQ ID NO: 970337 - DNA, 25 bp, Mus musculus
tttctcccgcccatgagaagagcca

SEQ ID NO: 970338 - DNA, 25 bp, Mus musculus
tttctcccgcccttgagaagagcca

SEQ ID NO: 970339 - DNA, 25 bp, Mus musculus
tttctcccggctattggataaagct

SEQ ID NO: 970340 - DNA, 25 bp, Mus musculus
tttctcccggcttttggataaagct

SEQ ID NO: 970341 - DNA, 25 bp, Mus musculus
tttctccctaggagagaaggctgaa

SEQ ID NO: 970342 - DNA, 25 bp, Mus musculus
tttctccctaggtgagaaggctgaa

SEQ ID NO: 970343 - DNA, 25 bp, Mus musculus
tttctccctattcgataaagatggt

SEQ ID NO: 970344 - DNA, 25 bp, Mus musculus
tttctccctattggataaagatggt

SEQ ID NO: 970345 - DNA, 25 bp, Mus musculus
tttctccctcaccaggatttcattt

SEQ ID NO: 970346 - DNA, 25 bp, Mus musculus
tttctccctcacgaggatttcattt

SEQ ID NO: 970347 - DNA, 25 bp, Mus musculus
tttctccctcatattgttcctaact

SEQ ID NO: 970348 - DNA, 25 bp, Mus musculus
tttctccctcattttgttcctaact

SEQ ID NO: 970349 - DNA, 25 bp, Mus musculus
tttctccctctaatcgcaatatggg

SEQ ID NO: 970350 - DNA, 25 bp, Mus musculus
tttctccctctattcgcaatatggg

SEQ ID NO: 970351 - DNA, 25 bp, Mus musculus
tttctccctgatccacaagtaattg

SEQ ID NO: 970352 - DNA, 25 bp, Mus musculus
tttctccctgatgcacaagtaattg

SEQ ID NO: 970353 - DNA, 25 bp, Mus musculus
tttctcccttccattaggcacaatg

SEQ ID NO: 970354 - DNA, 25 bp, Mus musculus
tttctcccttcctttaggcacaatg

SEQ ID NO: 970355 - DNA, 25 bp, Mus musculus
tttctcccttggcatttatgactgt

SEQ ID NO: 970356 - DNA, 25 bp, Mus musculus
tttctcccttgggatttatgactgt

SEQ ID NO: 970357 - DNA, 25 bp, Mus musculus
tttctccgacttaacacagctgatt

SEQ ID NO: 970358 - DNA, 25 bp, Mus musculus
tttctccgactttacacagctgatt

SEQ ID NO: 970359 - DNA, 25 bp, Mus musculus
tttctccgattgagctgtgtggtca

SEQ ID NO: 970360 - DNA, 25 bp, Mus musculus
tttctccgattgtgctgtgtggtca

SEQ ID NO: 970361 - DNA, 25 bp, Mus musculus
tttctccggtaacccattccacatg

SEQ ID NO: 970362 - DNA, 25 bp, Mus musculus
tttctccggtaagccattccacatg

SEQ ID NO: 970363 - DNA, 25 bp, Mus musculus
tttctcctcagcagtaaccatggta

SEQ ID NO: 970364 - DNA, 25 bp, Mus musculus
tttctcctcagctgtaaccatggta

SEQ ID NO: 970365 - DNA, 25 bp, Mus musculus
tttctcctcagtcgcaagcactaca

SEQ ID NO: 970366 - DNA, 25 bp, Mus musculus
tttctcctcagtggcaagcactaca

SEQ ID NO: 970367 - DNA, 25 bp, Mus musculus
tttctcctcctgctgtattatccac

SEQ ID NO: 970368 - DNA, 25 bp, Mus musculus
tttctcctcctggtgtattatccac

SEQ ID NO: 970369 - DNA, 25 bp, Mus musculus
tttctcctccttctttaaaagccat

SEQ ID NO: 970370 - DNA, 25 bp, Mus musculus
tttctcctccttgtttaaaagccat

SEQ ID NO: 970371 - DNA, 25 bp, Mus musculus
tttctcctcggactcctatggaaac

SEQ ID NO: 970372 - DNA, 25 bp, Mus musculus
tttctcctcggagtcctatggaaac

SEQ ID NO: 970373 - DNA, 25 bp, Mus musculus
tttctcctctgcagactgggttctg

SEQ ID NO: 970374 - DNA, 25 bp, Mus musculus
tttctcctctgctgactgggttctg

SEQ ID NO: 970375 - DNA, 25 bp, Mus musculus
tttctcctctggatcttagcagaag

SEQ ID NO: 970376 - DNA, 25 bp, Mus musculus
tttctcctctggttcttagcagaag

SEQ ID NO: 970377 - DNA, 25 bp, Mus musculus
tttctcctcttgctgaggtgcagga

SEQ ID NO: 970378 - DNA, 25 bp, Mus musculus
tttctcctcttggtgaggtgcagga

SEQ ID NO: 970379 - DNA, 25 bp, Mus musculus
tttctcctgaaaacgtgccttagct

SEQ ID NO: 970380 - DNA, 25 bp, Mus musculus
tttctcctgaaatcgtgccttagct

SEQ ID NO: 970381 - DNA, 25 bp, Mus musculus
tttctcctgctaattcccgaagatg

SEQ ID NO: 970382 - DNA, 25 bp, Mus musculus
tttctcctgctatttcccgaagatg

SEQ ID NO: 970383 - DNA, 25 bp, Mus musculus
tttctcctgcttacacacaagtgac

SEQ ID NO: 970384 - DNA, 25 bp, Mus musculus
tttctcctgctttcacacaagtgac

SEQ ID NO: 970385 - DNA, 25 bp, Mus musculus
tttctcctggttcttactaacagca

SEQ ID NO: 970386 - DNA, 25 bp, Mus musculus
tttctcctggttgttactaacagca

SEQ ID NO: 970387 - DNA, 25 bp, Mus musculus
tttctcctgtagcatgaaccctgta

SEQ ID NO: 970388 - DNA, 25 bp, Mus musculus
tttctcctgtaggatgaaccctgta

SEQ ID NO: 970389 - DNA, 25 bp, Mus musculus
tttctcctgtgcatgtttttagaag

SEQ ID NO: 970390 - DNA, 25 bp, Mus musculus
tttctcctgtgcttgtttttagaag

SEQ ID NO: 970391 - DNA, 25 bp, Mus musculus
tttctcctgtgtaactggaaggcct

SEQ ID NO: 970392 - DNA, 25 bp, Mus musculus
tttctcctgtgtacactttctccag

SEQ ID NO: 970393 - DNA, 25 bp, Mus musculus
tttctcctgtgttactggaaggcct

SEQ ID NO: 970394 - DNA, 25 bp, Mus musculus
tttctcctgtgttcactttctccag

SEQ ID NO: 970395 - DNA, 25 bp, Mus musculus
tttctcctgttgaagtactcctcaa

SEQ ID NO: 970396 - DNA, 25 bp, Mus musculus
tttctcctgttgtagtactcctcaa

SEQ ID NO: 970397 - DNA, 25 bp, Mus musculus
tttctccttatgctgaggccctgta

SEQ ID NO: 970398 - DNA, 25 bp, Mus musculus
tttctccttatggtgaggccctgta

SEQ ID NO: 970399 - DNA, 25 bp, Mus musculus
tttctccttggaagcgcttggcaag

SEQ ID NO: 970400 - DNA, 25 bp, Mus musculus
tttctccttggatgcgcttggcaag

SEQ ID NO: 970401 - DNA, 25 bp, Mus musculus
tttctcctttgcaattggtccctga

SEQ ID NO: 970402 - DNA, 25 bp, Mus musculus
tttctcctttgcattcggtccaaga

SEQ ID NO: 970403 - DNA, 25 bp, Mus musculus
tttctcctttgctattggtccctga

SEQ ID NO: 970404 - DNA, 25 bp, Mus musculus
tttctcctttgctttcggtccaaga

SEQ ID NO: 970405 - DNA, 25 bp, Mus musculus
tttctccttttaaatatgtagatga

SEQ ID NO: 970406 - DNA, 25 bp, Mus musculus
tttctccttttatatatgtagatga

SEQ ID NO: 970407 - DNA, 25 bp, Mus musculus
tttctccttttcatggatctgtcaa

SEQ ID NO: 970408 - DNA, 25 bp, Mus musculus
tttctccttttcttggatctgtcaa

SEQ ID NO: 970409 - DNA, 25 bp, Mus musculus
tttctcgaatttatggcctctcttt

SEQ ID NO: 970410 - DNA, 25 bp, Mus musculus
tttctcgaatttttggcctctcttt

SEQ ID NO: 970411 - DNA, 25 bp, Mus musculus
tttctcgacaagaagtggtgcgtcc

SEQ ID NO: 970412 - DNA, 25 bp, Mus musculus
tttctcgacaagtagtggtgcgtcc

SEQ ID NO: 970413 - DNA, 25 bp, Mus musculus
tttctcgagggcacaggcttcttcg

SEQ ID NO: 970414 - DNA, 25 bp, Mus musculus
tttctcgagggctcaggcttcttcg

SEQ ID NO: 970415 - DNA, 25 bp, Mus musculus
tttctcgagtgccttgtgaacttaa

SEQ ID NO: 970416 - DNA, 25 bp, Mus musculus
tttctcgagtgcgttgtgaacttaa

SEQ ID NO: 970417 - DNA, 25 bp, Mus musculus
tttctcgccatcactcttaggtctt

SEQ ID NO: 970418 - DNA, 25 bp, Mus musculus
tttctcgccatctctcttaggtctt

SEQ ID NO: 970419 - DNA, 25 bp, Mus musculus
tttctcgcccaaagaatccgcttat

SEQ ID NO: 970420 - DNA, 25 bp, Mus musculus
tttctcgcccaatgaatccgcttat

SEQ ID NO: 970421 - DNA, 25 bp, Mus musculus
tttctcgcccacaggcaaggagtat

SEQ ID NO: 970422 - DNA, 25 bp, Mus musculus
tttctcgcccactggcaaggagtat

SEQ ID NO: 970423 - DNA, 25 bp, Mus musculus
tttctcgctcacacttgttctgtgg

SEQ ID NO: 970424 - DNA, 25 bp, Mus musculus
tttctcgctcactcttgttctgtgg

SEQ ID NO: 970425 - DNA, 25 bp, Mus musculus
tttctcggacctccgcagtgtgcgg

SEQ ID NO: 970426 - DNA, 25 bp, Mus musculus
tttctcggacctgcgcagtgtgcgg

SEQ ID NO: 970427 - DNA, 25 bp, Mus musculus
tttctcggactcatcggtgttgttg

SEQ ID NO: 970428 - DNA, 25 bp, Mus musculus
tttctcggactcttcggtgttgttg

SEQ ID NO: 970429 - DNA, 25 bp, Mus musculus
tttctcgggataccttctgtccttc

SEQ ID NO: 970430 - DNA, 25 bp, Mus musculus
tttctcgggatagcttctgtccttc

SEQ ID NO: 970431 - DNA, 25 bp, Mus musculus
tttctcgggctaagtcaggagcctg

SEQ ID NO: 970432 - DNA, 25 bp, Mus musculus
tttctcgggctatgtcaggagcctg

SEQ ID NO: 970433 - DNA, 25 bp, Mus musculus
tttctcgtaacgatctccgcttgga

SEQ ID NO: 970434 - DNA, 25 bp, Mus musculus
tttctcgtaacgttctccgcttgga

SEQ ID NO: 970435 - DNA, 25 bp, Mus musculus
tttctcgtcaagcatgtctactacc

SEQ ID NO: 970436 - DNA, 25 bp, Mus musculus
tttctcgtcaaggatgtctactacc

SEQ ID NO: 970437 - DNA, 25 bp, Mus musculus
tttctcgtcactcgcagcatggagg

SEQ ID NO: 970438 - DNA, 25 bp, Mus musculus
tttctcgtcactggcagcatggagg

SEQ ID NO: 970439 - DNA, 25 bp, Mus musculus
tttctcgtcttacgcggtcgatatg

SEQ ID NO: 970440 - DNA, 25 bp, Mus musculus
tttctcgtcttaggcggtcgatatg

SEQ ID NO: 970441 - DNA, 25 bp, Mus musculus
tttctcgttgcaattttaagtggtt

SEQ ID NO: 970442 - DNA, 25 bp, Mus musculus
tttctcgttgcatttttaagtggtt

SEQ ID NO: 970443 - DNA, 25 bp, Mus musculus
tttctctaactccatgggctttttt

SEQ ID NO: 970444 - DNA, 25 bp, Mus musculus
tttctctaactcgatgggctttttt

SEQ ID NO: 970445 - DNA, 25 bp, Mus musculus
tttctctaagatcatgggctgccgc

SEQ ID NO: 970446 - DNA, 25 bp, Mus musculus
tttctctaagatgatgggctgccgc

SEQ ID NO: 970447 - DNA, 25 bp, Mus musculus
tttctctacactctcattctcagaa

SEQ ID NO: 970448 - DNA, 25 bp, Mus musculus
tttctctacactgtcattctcagaa

SEQ ID NO: 970449 - DNA, 25 bp, Mus musculus
tttctctacgtccatcatcttcaag

SEQ ID NO: 970450 - DNA, 25 bp, Mus musculus
tttctctacgtcgatcatcttcaag

SEQ ID NO: 970451 - DNA, 25 bp, Mus musculus
tttctctacttcacgaatctgccaa

SEQ ID NO: 970452 - DNA, 25 bp, Mus musculus
tttctctacttctcgaatctgccaa

SEQ ID NO: 970453 - DNA, 25 bp, Mus musculus
tttctctactttctgggaacccaag

SEQ ID NO: 970454 - DNA, 25 bp, Mus musculus
tttctctactttgtgggaacccaag

SEQ ID NO: 970455 - DNA, 25 bp, Mus musculus
tttctctagaataacctggcccaga

SEQ ID NO: 970456 - DNA, 25 bp, Mus musculus
tttctctagaattacctggcccaga

SEQ ID NO: 970457 - DNA, 25 bp, Mus musculus
tttctctagagcctgcattacccat

SEQ ID NO: 970458 - DNA, 25 bp, Mus musculus
tttctctagagcgtgcattacccat

SEQ ID NO: 970459 - DNA, 25 bp, Mus musculus
tttctctagtcaacagtgcctcttg

SEQ ID NO: 970460 - DNA, 25 bp, Mus musculus
tttctctagtcatcagtgcctcttg

SEQ ID NO: 970461 - DNA, 25 bp, Mus musculus
tttctctagtgtatatttctaccaa

SEQ ID NO: 970462 - DNA, 25 bp, Mus musculus
tttctctagtgtttatttctaccaa

SEQ ID NO: 970463 - DNA, 25 bp, Mus musculus
tttctctagttcagcatgcttaaag

SEQ ID NO: 970464 - DNA, 25 bp, Mus musculus
tttctctagttctgcatgcttaaag

SEQ ID NO: 970465 - DNA, 25 bp, Mus musculus
tttctctatcccagcaataatccca

SEQ ID NO: 970466 - DNA, 25 bp, Mus musculus
tttctctatccctgcaataatccca

SEQ ID NO: 970467 - DNA, 25 bp, Mus musculus
tttctctatttgctttctgctcaca

SEQ ID NO: 970468 - DNA, 25 bp, Mus musculus
tttctctatttggtttctgctcaca

SEQ ID NO: 970469 - DNA, 25 bp, Mus musculus
tttctctcaaaaagtttatcttcaa

SEQ ID NO: 970470 - DNA, 25 bp, Mus musculus
tttctctcaaaatgtttatcttcaa

SEQ ID NO: 970471 - DNA, 25 bp, Mus musculus
tttctctcaacgaggcctgtatttt

SEQ ID NO: 970472 - DNA, 25 bp, Mus musculus
tttctctcaacgtggcctgtatttt

SEQ ID NO: 970473 - DNA, 25 bp, Mus musculus
tttctctcacaaagactccaggaat

SEQ ID NO: 970474 - DNA, 25 bp, Mus musculus
tttctctcacaatgactccaggaat

SEQ ID NO: 970475 - DNA, 25 bp, Mus musculus
tttctctcactgagaagctcttcag

SEQ ID NO: 970476 - DNA, 25 bp, Mus musculus
tttctctcactgcatgcatcagtaa

SEQ ID NO: 970477 - DNA, 25 bp, Mus musculus
tttctctcactggatgcatcagtaa

SEQ ID NO: 970478 - DNA, 25 bp, Mus musculus
tttctctcactgtgaagctcttcag

SEQ ID NO: 970479 - DNA, 25 bp, Mus musculus
tttctctcacttcccctttagaaag

SEQ ID NO: 970480 - DNA, 25 bp, Mus musculus
tttctctcacttgccctttagaaag

SEQ ID NO: 970481 - DNA, 25 bp, Mus musculus
tttctctcatacacagatttcaatg

SEQ ID NO: 970482 - DNA, 25 bp, Mus musculus
tttctctcatactcagatttcaatg

SEQ ID NO: 970483 - DNA, 25 bp, Mus musculus
tttctctcattcaaaaccttcatct

SEQ ID NO: 970484 - DNA, 25 bp, Mus musculus
tttctctcattctaaaccttcatct

SEQ ID NO: 970485 - DNA, 25 bp, Mus musculus
tttctctcattgcacttttaaggga

SEQ ID NO: 970486 - DNA, 25 bp, Mus musculus
tttctctcattggacttttaaggga

SEQ ID NO: 970487 - DNA, 25 bp, Mus musculus
tttctctccacacatctgagataaa

SEQ ID NO: 970488 - DNA, 25 bp, Mus musculus
tttctctccacagatctgagataaa

SEQ ID NO: 970489 - DNA, 25 bp, Mus musculus
tttctctccatcaaaggagctttgg

SEQ ID NO: 970490 - DNA, 25 bp, Mus musculus
tttctctccatctaaggagctttgg

SEQ ID NO: 970491 - DNA, 25 bp, Mus musculus
tttctctccattcacctttgtgttc

SEQ ID NO: 970492 - DNA, 25 bp, Mus musculus
tttctctccattgacctttgtgttc

SEQ ID NO: 970493 - DNA, 25 bp, Mus musculus
tttctctcccctcactagcaattag

SEQ ID NO: 970494 - DNA, 25 bp, Mus musculus
tttctctcccctctagtgttaagga

SEQ ID NO: 970495 - DNA, 25 bp, Mus musculus
tttctctcccctgactagcaattag

SEQ ID NO: 970496 - DNA, 25 bp, Mus musculus
tttctctcccctgtagtgttaagga

SEQ ID NO: 970497 - DNA, 25 bp, Mus musculus
tttctctccctaccggaaatctgat

SEQ ID NO: 970498 - DNA, 25 bp, Mus musculus
tttctctccctacttgggactgtga

SEQ ID NO: 970499 - DNA, 25 bp, Mus musculus
tttctctccctagcggaaatctgat

SEQ ID NO: 970500 - DNA, 25 bp, Mus musculus
tttctctccctagttgggactgtga

SEQ ID NO: 970501 - DNA, 25 bp, Mus musculus
tttctctccctcaactgtgtaagtg

SEQ ID NO: 970502 - DNA, 25 bp, Mus musculus
tttctctccctcaagttctagtaaa

SEQ ID NO: 970503 - DNA, 25 bp, Mus musculus
tttctctccctctactgtgtaagtg

SEQ ID NO: 970504 - DNA, 25 bp, Mus musculus
tttctctccctctagttctagtaaa

SEQ ID NO: 970505 - DNA, 25 bp, Mus musculus
tttctctcccttcctagagggcaaa

SEQ ID NO: 970506 - DNA, 25 bp, Mus musculus
tttctctcccttgctagagggcaaa

SEQ ID NO: 970507 - DNA, 25 bp, Mus musculus
tttctctcctctaatcatctaacat

SEQ ID NO: 970508 - DNA, 25 bp, Mus musculus
tttctctcctcttatcatctaacat

SEQ ID NO: 970509 - DNA, 25 bp, Mus musculus
tttctctctcagagtcctagcttga

SEQ ID NO: 970510 - DNA, 25 bp, Mus musculus
tttctctctcagtgtcctagcttga

SEQ ID NO: 970511 - DNA, 25 bp, Mus musculus
tttctctctcatctggaagtattta

SEQ ID NO: 970512 - DNA, 25 bp, Mus musculus
tttctctctcatgtggaagtattta

SEQ ID NO: 970513 - DNA, 25 bp, Mus musculus
tttctctctcccaaattaactgcct

SEQ ID NO: 970514 - DNA, 25 bp, Mus musculus
tttctctctccctaattaactgcct

SEQ ID NO: 970515 - DNA, 25 bp, Mus musculus
tttctctctcctagacaataaagtc

SEQ ID NO: 970516 - DNA, 25 bp, Mus musculus
tttctctctcctcgcacagctgatg

SEQ ID NO: 970517 - DNA, 25 bp, Mus musculus
tttctctctcctggcacagctgatg

SEQ ID NO: 970518 - DNA, 25 bp, Mus musculus
tttctctctccttgacaataaagtc

SEQ ID NO: 970519 - DNA, 25 bp, Mus musculus
tttctctctctgcaaggccttgatt

SEQ ID NO: 970520 - DNA, 25 bp, Mus musculus
tttctctctctggaaggccttgatt

SEQ ID NO: 970521 - DNA, 25 bp, Mus musculus
tttctctctcttacatggtcacata

SEQ ID NO: 970522 - DNA, 25 bp, Mus musculus
tttctctctcttagacaggaatcag

SEQ ID NO: 970523 - DNA, 25 bp, Mus musculus
tttctctctctttcatggtcacata

SEQ ID NO: 970524 - DNA, 25 bp, Mus musculus
tttctctctctttgacaggaatcag

SEQ ID NO: 970525 - DNA, 25 bp, Mus musculus
tttctctctgggaggtgagatttgg

SEQ ID NO: 970526 - DNA, 25 bp, Mus musculus
tttctctctgggtggtgagatttgg

SEQ ID NO: 970527 - DNA, 25 bp, Mus musculus
tttctctctgtaaccttgagcccca

SEQ ID NO: 970528 - DNA, 25 bp, Mus musculus
tttctctctgtacacttggggcgtg

SEQ ID NO: 970529 - DNA, 25 bp, Mus musculus
tttctctctgtagacttggggcgtg

SEQ ID NO: 970530 - DNA, 25 bp, Mus musculus
tttctctctgtatccttgagcccca

SEQ ID NO: 970531 - DNA, 25 bp, Mus musculus
tttctctctgtgcaggaagcagcgt

SEQ ID NO: 970532 - DNA, 25 bp, Mus musculus
tttctctctgtggaggaagcagcgt

SEQ ID NO: 970533 - DNA, 25 bp, Mus musculus
tttctctctgttaaatggatgtgta

SEQ ID NO: 970534 - DNA, 25 bp, Mus musculus
tttctctctgttaatgtacttactc

SEQ ID NO: 970535 - DNA, 25 bp, Mus musculus
tttctctctgttcttagttttttgt

SEQ ID NO: 970536 - DNA, 25 bp, Mus musculus
tttctctctgttgttagttttttgt

SEQ ID NO: 970537 - DNA, 25 bp, Mus musculus
tttctctctgtttaatggatgtgta

SEQ ID NO: 970538 - DNA, 25 bp, Mus musculus
tttctctctgtttatgtacttactc

SEQ ID NO: 970539 - DNA, 25 bp, Mus musculus
tttctctcttaaataccttggttca

SEQ ID NO: 970540 - DNA, 25 bp, Mus musculus
tttctctcttaattaccttggttca

SEQ ID NO: 970541 - DNA, 25 bp, Mus musculus
tttctctgaaacattccccatcctg

SEQ ID NO: 970542 - DNA, 25 bp, Mus musculus
tttctctgaaactttccccatcctg

SEQ ID NO: 970543 - DNA, 25 bp, Mus musculus
tttctctgaaccactttccaaaggg

SEQ ID NO: 970544 - DNA, 25 bp, Mus musculus
tttctctgaacctctttccaaaggg

SEQ ID NO: 970545 - DNA, 25 bp, Mus musculus
tttctctgaagcattagctgaaagt

SEQ ID NO: 970546 - DNA, 25 bp, Mus musculus
tttctctgaagctttagctgaaagt

SEQ ID NO: 970547 - DNA, 25 bp, Mus musculus
tttctctgaccaatctagtgtactg

SEQ ID NO: 970548 - DNA, 25 bp, Mus musculus
tttctctgaccaattctcttccagg

SEQ ID NO: 970549 - DNA, 25 bp, Mus musculus
tttctctgaccattctagtgtactg

SEQ ID NO: 970550 - DNA, 25 bp, Mus musculus
tttctctgaccatttctcttccagg

SEQ ID NO: 970551 - DNA, 25 bp, Mus musculus
tttctctgagccatggatgagggaa

SEQ ID NO: 970552 - DNA, 25 bp, Mus musculus
tttctctgagccttggatgagggaa

SEQ ID NO: 970553 - DNA, 25 bp, Mus musculus
tttctctgaggtctgtaaggtagcc

SEQ ID NO: 970554 - DNA, 25 bp, Mus musculus
tttctctgaggtgtgtaaggtagcc

SEQ ID NO: 970555 - DNA, 25 bp, Mus musculus
tttctctgagtacaagcctagcctg

SEQ ID NO: 970556 - DNA, 25 bp, Mus musculus
tttctctgagtagaagcctagcctg

SEQ ID NO: 970557 - DNA, 25 bp, Mus musculus
tttctctgatcaaatgcaccttgtc

SEQ ID NO: 970558 - DNA, 25 bp, Mus musculus
tttctctgatcatatgcaccttgtc

SEQ ID NO: 970559 - DNA, 25 bp, Mus musculus
tttctctgcagactgtgatgcccaa

SEQ ID NO: 970560 - DNA, 25 bp, Mus musculus
tttctctgcagagtgtgatgcccaa

SEQ ID NO: 970561 - DNA, 25 bp, Mus musculus
tttctctgcatcaaaccctgcatga

SEQ ID NO: 970562 - DNA, 25 bp, Mus musculus
tttctctgcatctaaccctgcatga

SEQ ID NO: 970563 - DNA, 25 bp, Mus musculus
tttctctgcatgatgtaacctgtgt

SEQ ID NO: 970564 - DNA, 25 bp, Mus musculus
tttctctgcatgttgtaacctgtgt

SEQ ID NO: 970565 - DNA, 25 bp, Mus musculus
tttctctgcattctttcctgggata

SEQ ID NO: 970566 - DNA, 25 bp, Mus musculus
tttctctgcattgtttcctgggata

SEQ ID NO: 970567 - DNA, 25 bp, Mus musculus
tttctctgcctactggttgaactgc

SEQ ID NO: 970568 - DNA, 25 bp, Mus musculus
tttctctgcctagtggttgaactgc

SEQ ID NO: 970569 - DNA, 25 bp, Mus musculus
tttctctgcctgatatttcctatct

SEQ ID NO: 970570 - DNA, 25 bp, Mus musculus
tttctctgcctgttatttcctatct

SEQ ID NO: 970571 - DNA, 25 bp, Mus musculus
tttctctgcgtacgcctggatgttc

SEQ ID NO: 970572 - DNA, 25 bp, Mus musculus
tttctctgcgtaggcctggatgttc

SEQ ID NO: 970573 - DNA, 25 bp, Mus musculus
tttctctgctagctgctagctgcta

SEQ ID NO: 970574 - DNA, 25 bp, Mus musculus
tttctctgctaggtgctagctgcta

SEQ ID NO: 970575 - DNA, 25 bp, Mus musculus
tttctctgctatctccaagtaaccc

SEQ ID NO: 970576 - DNA, 25 bp, Mus musculus
tttctctgctatgtccaagtaaccc

SEQ ID NO: 970577 - DNA, 25 bp, Mus musculus
tttctctggagcacatcgaacgagg

SEQ ID NO: 970578 - DNA, 25 bp, Mus musculus
tttctctggagctcatcgaacgagg

SEQ ID NO: 970579 - DNA, 25 bp, Mus musculus
tttctctggaggcatcatgcgctgg

SEQ ID NO: 970580 - DNA, 25 bp, Mus musculus
tttctctggagggatcatgcgctgg

SEQ ID NO: 970581 - DNA, 25 bp, Mus musculus
tttctctggcatactggacattgtg

SEQ ID NO: 970582 - DNA, 25 bp, Mus musculus
tttctctggcattctggacattgtg

SEQ ID NO: 970583 - DNA, 25 bp, Mus musculus
tttctctggcgaaggcaatcttcag

SEQ ID NO: 970584 - DNA, 25 bp, Mus musculus
tttctctggcgatggcaatcttcag

SEQ ID NO: 970585 - DNA, 25 bp, Mus musculus
tttctctgggacatttctttgtgtg

SEQ ID NO: 970586 - DNA, 25 bp, Mus musculus
tttctctgggacttttctttgtgtg

SEQ ID NO: 970587 - DNA, 25 bp, Mus musculus
tttctctgggatcaaattcaaataa

SEQ ID NO: 970588 - DNA, 25 bp, Mus musculus
tttctctgggatgaaattcaaataa

SEQ ID NO: 970589 - DNA, 25 bp, Mus musculus
tttctctgggcaccctggataattt

SEQ ID NO: 970590 - DNA, 25 bp, Mus musculus
tttctctgggcagcctggataattt

SEQ ID NO: 970591 - DNA, 25 bp, Mus musculus
tttctctgggccatccaattgggat

SEQ ID NO: 970592 - DNA, 25 bp, Mus musculus
tttctctgggccttccaattgggat

SEQ ID NO: 970593 - DNA, 25 bp, Mus musculus
tttctctgtagcctgatatgaagat

SEQ ID NO: 970594 - DNA, 25 bp, Mus musculus
tttctctgtagcgtgatatgaagat

SEQ ID NO: 970595 - DNA, 25 bp, Mus musculus
tttctctgtaggatgttagcattgt

SEQ ID NO: 970596 - DNA, 25 bp, Mus musculus
tttctctgtaggttgttagcattgt

SEQ ID NO: 970597 - DNA, 25 bp, Mus musculus
tttctctgtcagagctgggcatata

SEQ ID NO: 970598 - DNA, 25 bp, Mus musculus
tttctctgtcagtgctgggcatata

SEQ ID NO: 970599 - DNA, 25 bp, Mus musculus
tttctctgtctccactactccataa

SEQ ID NO: 970600 - DNA, 25 bp, Mus musculus
tttctctgtctcgactactccataa

SEQ ID NO: 970601 - DNA, 25 bp, Mus musculus
tttctctgtcttccacaacataggg

SEQ ID NO: 970602 - DNA, 25 bp, Mus musculus
tttctctgtcttgcacaacataggg

SEQ ID NO: 970603 - DNA, 25 bp, Mus musculus
tttctctgtgtaagcccaattctta

SEQ ID NO: 970604 - DNA, 25 bp, Mus musculus
tttctctgtgtatgcccaattctta

SEQ ID NO: 970605 - DNA, 25 bp, Mus musculus
tttctctgtgtgatctgccacatca

SEQ ID NO: 970606 - DNA, 25 bp, Mus musculus
tttctctgtgtgttctgccacatca

SEQ ID NO: 970607 - DNA, 25 bp, Mus musculus
tttctctgtttaaggacccggatcc

SEQ ID NO: 970608 - DNA, 25 bp, Mus musculus
tttctctgtttatggacccggatcc

SEQ ID NO: 970609 - DNA, 25 bp, Mus musculus
tttctcttaaagagacgccatgtta

SEQ ID NO: 970610 - DNA, 25 bp, Mus musculus
tttctcttaaagtgacgccatgtta

SEQ ID NO: 970611 - DNA, 25 bp, Mus musculus
tttctcttacttcattgggccagac

SEQ ID NO: 970612 - DNA, 25 bp, Mus musculus
tttctcttacttgattgggccagac

SEQ ID NO: 970613 - DNA, 25 bp, Mus musculus
tttctcttaggtacagtatctgaca

SEQ ID NO: 970614 - DNA, 25 bp, Mus musculus
tttctcttaggttcagtatctgaca

SEQ ID NO: 970615 - DNA, 25 bp, Mus musculus
tttctcttcaatccattcgacacgg

SEQ ID NO: 970616 - DNA, 25 bp, Mus musculus
tttctcttcaatgcattcgacacgg

SEQ ID NO: 970617 - DNA, 25 bp, Mus musculus
tttctcttcaccagcctagtatatt

SEQ ID NO: 970618 - DNA, 25 bp, Mus musculus
tttctcttcacctgcctagtatatt

SEQ ID NO: 970619 - DNA, 25 bp, Mus musculus
tttctcttcagtatgtattcacatc

SEQ ID NO: 970620 - DNA, 25 bp, Mus musculus
tttctcttcagtttgtattcacatc

SEQ ID NO: 970621 - DNA, 25 bp, Mus musculus
tttctcttcatacatccctgttaca

SEQ ID NO: 970622 - DNA, 25 bp, Mus musculus
tttctcttcatagatccctgttaca

SEQ ID NO: 970623 - DNA, 25 bp, Mus musculus
tttctcttcatcctttggctggtgt

SEQ ID NO: 970624 - DNA, 25 bp, Mus musculus
tttctcttcatcgtttggctggtgt

SEQ ID NO: 970625 - DNA, 25 bp, Mus musculus
tttctcttcattcttcccttagatc

SEQ ID NO: 970626 - DNA, 25 bp, Mus musculus
tttctcttcattgttcccttagatc

SEQ ID NO: 970627 - DNA, 25 bp, Mus musculus
tttctcttcccaccatagcatgtgt

SEQ ID NO: 970628 - DNA, 25 bp, Mus musculus
tttctcttcccagcatagcatgtgt

SEQ ID NO: 970629 - DNA, 25 bp, Mus musculus
tttctcttccggaaccgtacactgg

SEQ ID NO: 970630 - DNA, 25 bp, Mus musculus
tttctcttccggtaccgtacactgg

SEQ ID NO: 970631 - DNA, 25 bp, Mus musculus
tttctcttcctcaggttgttattgg

SEQ ID NO: 970632 - DNA, 25 bp, Mus musculus
tttctcttcctctggttgttattgg

SEQ ID NO: 970633 - DNA, 25 bp, Mus musculus
tttctcttcggccatttgtgagagc

SEQ ID NO: 970634 - DNA, 25 bp, Mus musculus
tttctcttcggcgatttgtgagagc

SEQ ID NO: 970635 - DNA, 25 bp, Mus musculus
tttctcttctcaacagctgggatgc

SEQ ID NO: 970636 - DNA, 25 bp, Mus musculus
tttctcttctcatcagctgggatgc

SEQ ID NO: 970637 - DNA, 25 bp, Mus musculus
tttctcttctctatgtgtacgattg

SEQ ID NO: 970638 - DNA, 25 bp, Mus musculus
tttctcttctctcacaggtactgag

SEQ ID NO: 970639 - DNA, 25 bp, Mus musculus
tttctcttctctgacaggtactgag

SEQ ID NO: 970640 - DNA, 25 bp, Mus musculus
tttctcttctctttgtgtacgattg

SEQ ID NO: 970641 - DNA, 25 bp, Mus musculus
tttctcttcttacctttgtcggagt

SEQ ID NO: 970642 - DNA, 25 bp, Mus musculus
tttctcttcttagctttgtcggagt

SEQ ID NO: 970643 - DNA, 25 bp, Mus musculus
tttctcttctttcgtagtaacgtat

SEQ ID NO: 970644 - DNA, 25 bp, Mus musculus
tttctcttctttggtagtaacgtat

SEQ ID NO: 970645 - DNA, 25 bp, Mus musculus
tttctcttgagtacctgctaggttt

SEQ ID NO: 970646 - DNA, 25 bp, Mus musculus
tttctcttgagttcctgctaggttt

SEQ ID NO: 970647 - DNA, 25 bp, Mus musculus
tttctcttgcttaggatttggtgac

SEQ ID NO: 970648 - DNA, 25 bp, Mus musculus
tttctcttgctttggatttggtgac

SEQ ID NO: 970649 - DNA, 25 bp, Mus musculus
tttctcttgggcagcagtgaactgt

SEQ ID NO: 970650 - DNA, 25 bp, Mus musculus
tttctcttgggctgcagtgaactgt

SEQ ID NO: 970651 - DNA, 25 bp, Mus musculus
tttctcttggtcatcgcttgtaatg

SEQ ID NO: 970652 - DNA, 25 bp, Mus musculus
tttctcttggtcttcgcttgtaatg

SEQ ID NO: 970653 - DNA, 25 bp, Mus musculus
tttctcttgtgcacgtgggtatgac

SEQ ID NO: 970654 - DNA, 25 bp, Mus musculus
tttctcttgtgctcgtgggtatgac

SEQ ID NO: 970655 - DNA, 25 bp, Mus musculus
tttctctttaatcatgtcattgctt

SEQ ID NO: 970656 - DNA, 25 bp, Mus musculus
tttctctttaatcgacacaatgctg

SEQ ID NO: 970657 - DNA, 25 bp, Mus musculus
tttctctttaatgatgtcattgctt

SEQ ID NO: 970658 - DNA, 25 bp, Mus musculus
tttctctttaatggacacaatgctg

SEQ ID NO: 970659 - DNA, 25 bp, Mus musculus
tttctctttagacggcgggcatatg

SEQ ID NO: 970660 - DNA, 25 bp, Mus musculus
tttctctttagagggcgggcatatg

SEQ ID NO: 970661 - DNA, 25 bp, Mus musculus
tttctctttcctccatttatgaacc

SEQ ID NO: 970662 - DNA, 25 bp, Mus musculus
tttctctttcctgcatttatgaacc

SEQ ID NO: 970663 - DNA, 25 bp, Mus musculus
tttctctttgccaacagaccacatt

SEQ ID NO: 970664 - DNA, 25 bp, Mus musculus
tttctctttgcctacagaccacatt

SEQ ID NO: 970665 - DNA, 25 bp, Mus musculus
tttctctttggacgatttaccactg

SEQ ID NO: 970666 - DNA, 25 bp, Mus musculus
tttctctttggaggatttaccactg

SEQ ID NO: 970667 - DNA, 25 bp, Mus musculus
tttctctttgtactggcaaatgcac

SEQ ID NO: 970668 - DNA, 25 bp, Mus musculus
tttctctttgtagtggcaaatgcac

SEQ ID NO: 970669 - DNA, 25 bp, Mus musculus
tttctctttgtcatggcttatcttc

SEQ ID NO: 970670 - DNA, 25 bp, Mus musculus
tttctctttgtcattgcatctctta

SEQ ID NO: 970671 - DNA, 25 bp, Mus musculus
tttctctttgtcttggcttatcttc

SEQ ID NO: 970672 - DNA, 25 bp, Mus musculus
tttctctttgtctttgcatctctta

SEQ ID NO: 970673 - DNA, 25 bp, Mus musculus
tttctctttgttaaagtagcttctt

SEQ ID NO: 970674 - DNA, 25 bp, Mus musculus
tttctctttgtttaagtagcttctt

SEQ ID NO: 970675 - DNA, 25 bp, Mus musculus
tttctcttttaaccacttacatggg

SEQ ID NO: 970676 - DNA, 25 bp, Mus musculus
tttctcttttaagcacttacatggg

SEQ ID NO: 970677 - DNA, 25 bp, Mus musculus
tttctgaaaaccaagcaaacacatg

SEQ ID NO: 970678 - DNA, 25 bp, Mus musculus
tttctgaaaacctagcaaacacatg

SEQ ID NO: 970679 - DNA, 25 bp, Mus musculus
tttctgaaactcctgtggctcagag

SEQ ID NO: 970680 - DNA, 25 bp, Mus musculus
tttctgaaactcgtgtggctcagag

SEQ ID NO: 970681 - DNA, 25 bp, Mus musculus
tttctgaaatcactcttgggactgc

SEQ ID NO: 970682 - DNA, 25 bp, Mus musculus
tttctgaaatcagtcttgggactgc

SEQ ID NO: 970683 - DNA, 25 bp, Mus musculus
tttctgaacagcaggtgtagctaca

SEQ ID NO: 970684 - DNA, 25 bp, Mus musculus
tttctgaacagctggtgtagctaca

SEQ ID NO: 970685 - DNA, 25 bp, Mus musculus
tttctgaaccacatgtctgtgcttt

SEQ ID NO: 970686 - DNA, 25 bp, Mus musculus
tttctgaaccacttgtctgtgcttt

SEQ ID NO: 970687 - DNA, 25 bp, Mus musculus
tttctgaaccccatattattcttat

SEQ ID NO: 970688 - DNA, 25 bp, Mus musculus
tttctgaaccccttattattcttat

SEQ ID NO: 970689 - DNA, 25 bp, Mus musculus
tttctgaaccttccctcagggtggg

SEQ ID NO: 970690 - DNA, 25 bp, Mus musculus
tttctgaaccttgcctcagggtggg

SEQ ID NO: 970691 - DNA, 25 bp, Mus musculus
tttctgaactggagtgtggcttcgt

SEQ ID NO: 970692 - DNA, 25 bp, Mus musculus
tttctgaactggtgtgtggcttcgt

SEQ ID NO: 970693 - DNA, 25 bp, Mus musculus
tttctgaagccccagtgctaggtag

SEQ ID NO: 970694 - DNA, 25 bp, Mus musculus
tttctgaagcccgagtgctaggtag

SEQ ID NO: 970695 - DNA, 25 bp, Mus musculus
tttctgaatcctcaactggttactc

SEQ ID NO: 970696 - DNA, 25 bp, Mus musculus
tttctgaatcctgaactggttactc

SEQ ID NO: 970697 - DNA, 25 bp, Mus musculus
tttctgaatgaccacctcccaattc

SEQ ID NO: 970698 - DNA, 25 bp, Mus musculus
tttctgaatgacgacctcccaattc

SEQ ID NO: 970699 - DNA, 25 bp, Mus musculus
tttctgaatgagactaagtcccaag

SEQ ID NO: 970700 - DNA, 25 bp, Mus musculus
tttctgaatgagtctaagtcccaag

SEQ ID NO: 970701 - DNA, 25 bp, Mus musculus
tttctgaatgccacctaatttctct

SEQ ID NO: 970702 - DNA, 25 bp, Mus musculus
tttctgaatgcctcctaatttctct

SEQ ID NO: 970703 - DNA, 25 bp, Mus musculus
tttctgaatgtaccccagtggatgt

SEQ ID NO: 970704 - DNA, 25 bp, Mus musculus
tttctgaatgtagcccagtggatgt

SEQ ID NO: 970705 - DNA, 25 bp, Mus musculus
tttctgaatgtcagtgtgggtgccc

SEQ ID NO: 970706 - DNA, 25 bp, Mus musculus
tttctgaatgtctgtgtgggtgccc

SEQ ID NO: 970707 - DNA, 25 bp, Mus musculus
tttctgaccataatcactgaggacc

SEQ ID NO: 970708 - DNA, 25 bp, Mus musculus
tttctgaccatattcactgaggacc

SEQ ID NO: 970709 - DNA, 25 bp, Mus musculus
tttctgaccattacatgctgattgt

SEQ ID NO: 970710 - DNA, 25 bp, Mus musculus
tttctgaccatttcatgctgattgt

SEQ ID NO: 970711 - DNA, 25 bp, Mus musculus
tttctgacccgacaggtacatttgt

SEQ ID NO: 970712 - DNA, 25 bp, Mus musculus
tttctgacccgagaggtacatttgt

SEQ ID NO: 970713 - DNA, 25 bp, Mus musculus
tttctgacctgccatgtctcgcctg

SEQ ID NO: 970714 - DNA, 25 bp, Mus musculus
tttctgacctgcgatgtctcgcctg

SEQ ID NO: 970715 - DNA, 25 bp, Mus musculus
tttctgacgttgctgtacctcacaa

SEQ ID NO: 970716 - DNA, 25 bp, Mus musculus
tttctgacgttggtgtacctcacaa

SEQ ID NO: 970717 - DNA, 25 bp, Mus musculus
tttctgactagccactgcattgggc

SEQ ID NO: 970718 - DNA, 25 bp, Mus musculus
tttctgactagcgactgcattgggc

SEQ ID NO: 970719 - DNA, 25 bp, Mus musculus
tttctgactcctcggaaaagacaat

SEQ ID NO: 970720 - DNA, 25 bp, Mus musculus
tttctgactcctgggaaaagacaat

SEQ ID NO: 970721 - DNA, 25 bp, Mus musculus
tttctgactcttaagctcccaatca

SEQ ID NO: 970722 - DNA, 25 bp, Mus musculus
tttctgactctttagctcccaatca

SEQ ID NO: 970723 - DNA, 25 bp, Mus musculus
tttctgactgccaggaggatgtctg

SEQ ID NO: 970724 - DNA, 25 bp, Mus musculus
tttctgactgcctggaggatgtctg

SEQ ID NO: 970725 - DNA, 25 bp, Mus musculus
tttctgactgttagcttttctcgta

SEQ ID NO: 970726 - DNA, 25 bp, Mus musculus
tttctgactgtttgcttttctcgta

SEQ ID NO: 970727 - DNA, 25 bp, Mus musculus
tttctgactttgatcttgggaacca

SEQ ID NO: 970728 - DNA, 25 bp, Mus musculus
tttctgactttgttcttgggaacca

SEQ ID NO: 970729 - DNA, 25 bp, Mus musculus
tttctgagaacacggaagcgctctt

SEQ ID NO: 970730 - DNA, 25 bp, Mus musculus
tttctgagaacagggaagcgctctt

SEQ ID NO: 970731 - DNA, 25 bp, Mus musculus
tttctgagaaccaggtgtcctagga

SEQ ID NO: 970732 - DNA, 25 bp, Mus musculus
tttctgagaaccctcgaccggtggc

SEQ ID NO: 970733 - DNA, 25 bp, Mus musculus
tttctgagaaccgtcgaccggtggc

SEQ ID NO: 970734 - DNA, 25 bp, Mus musculus
tttctgagaacctggtgtcctagga

SEQ ID NO: 970735 - DNA, 25 bp, Mus musculus
tttctgagagaaaccttcgcccagc

SEQ ID NO: 970736 - DNA, 25 bp, Mus musculus
tttctgagagaatccttcgcccagc

SEQ ID NO: 970737 - DNA, 25 bp, Mus musculus
tttctgagagtgagggtctcatcaa

SEQ ID NO: 970738 - DNA, 25 bp, Mus musculus
tttctgagagtgtgggtctcatcaa

SEQ ID NO: 970739 - DNA, 25 bp, Mus musculus
tttctgagattacccagctggacat

SEQ ID NO: 970740 - DNA, 25 bp, Mus musculus
tttctgagattagccagctggacat

SEQ ID NO: 970741 - DNA, 25 bp, Mus musculus
tttctgagcacacggctgggttgcc

SEQ ID NO: 970742 - DNA, 25 bp, Mus musculus
tttctgagcacagggctgggttgcc

SEQ ID NO: 970743 - DNA, 25 bp, Mus musculus
tttctgagccagagcagtgcctctc

SEQ ID NO: 970744 - DNA, 25 bp, Mus musculus
tttctgagccagtgcagtgcctctc

SEQ ID NO: 970745 - DNA, 25 bp, Mus musculus
tttctgagctacaaagtctacgtcc

SEQ ID NO: 970746 - DNA, 25 bp, Mus musculus
tttctgagctactaagtctacgtcc

SEQ ID NO: 970747 - DNA, 25 bp, Mus musculus
tttctgaggctgctctactcaccag

SEQ ID NO: 970748 - DNA, 25 bp, Mus musculus
tttctgaggctggtctactcaccag

SEQ ID NO: 970749 - DNA, 25 bp, Mus musculus
tttctgagtcttaaaggaactcctg

SEQ ID NO: 970750 - DNA, 25 bp, Mus musculus
tttctgagtctttaaggaactcctg

SEQ ID NO: 970751 - DNA, 25 bp, Mus musculus
tttctgagtggtagatgcggctcca

SEQ ID NO: 970752 - DNA, 25 bp, Mus musculus
tttctgagtggttgatgcggctcca

SEQ ID NO: 970753 - DNA, 25 bp, Mus musculus
tttctgagtgtcactcaaccctgtg

SEQ ID NO: 970754 - DNA, 25 bp, Mus musculus
tttctgagtgtctctcaaccctgtg

SEQ ID NO: 970755 - DNA, 25 bp, Mus musculus
tttctgataaccagactgccggacc

SEQ ID NO: 970756 - DNA, 25 bp, Mus musculus
tttctgataacctgactgccggacc

SEQ ID NO: 970757 - DNA, 25 bp, Mus musculus
tttctgatattccagggcactgtat

SEQ ID NO: 970758 - DNA, 25 bp, Mus musculus
tttctgatattcgagggcactgtat

SEQ ID NO: 970759 - DNA, 25 bp, Mus musculus
tttctgatctgcactcattctgaat

SEQ ID NO: 970760 - DNA, 25 bp, Mus musculus
tttctgatctgctctcattctgaat

SEQ ID NO: 970761 - DNA, 25 bp, Mus musculus
tttctgatgaccaccaatcctgact

SEQ ID NO: 970762 - DNA, 25 bp, Mus musculus
tttctgatgacctccaatcctgact

SEQ ID NO: 970763 - DNA, 25 bp, Mus musculus
tttctgatggccctgctcgtaggag

SEQ ID NO: 970764 - DNA, 25 bp, Mus musculus
tttctgatggccgtgctcgtaggag

SEQ ID NO: 970765 - DNA, 25 bp, Mus musculus
tttctgatgggactttaggcctctc

SEQ ID NO: 970766 - DNA, 25 bp, Mus musculus
tttctgatgggagtttaggcctctc

SEQ ID NO: 970767 - DNA, 25 bp, Mus musculus
tttctgatgtgtaaaccccacccag

SEQ ID NO: 970768 - DNA, 25 bp, Mus musculus
tttctgatgtgttaaccccacccag

SEQ ID NO: 970769 - DNA, 25 bp, Mus musculus
tttctgattagcattcatccggtct

SEQ ID NO: 970770 - DNA, 25 bp, Mus musculus
tttctgattagctttcatccggtct

SEQ ID NO: 970771 - DNA, 25 bp, Mus musculus
tttctgattctcagtacaagctgac

SEQ ID NO: 970772 - DNA, 25 bp, Mus musculus
tttctgattctcatcttcataccag

SEQ ID NO: 970773 - DNA, 25 bp, Mus musculus
tttctgattctctgtacaagctgac

SEQ ID NO: 970774 - DNA, 25 bp, Mus musculus
tttctgattctcttcttcataccag

SEQ ID NO: 970775 - DNA, 25 bp, Mus musculus
tttctgattctgaggccccagcgta

SEQ ID NO: 970776 - DNA, 25 bp, Mus musculus
tttctgattctgtggccccagcgta

SEQ ID NO: 970777 - DNA, 25 bp, Mus musculus
tttctgcaaagcctaccacggaggc

SEQ ID NO: 970778 - DNA, 25 bp, Mus musculus
tttctgcaaagcgtaccacggaggc

SEQ ID NO: 970779 - DNA, 25 bp, Mus musculus
tttctgcaaccaacatctactctac

SEQ ID NO: 970780 - DNA, 25 bp, Mus musculus
tttctgcaaccatcatctactctac

SEQ ID NO: 970781 - DNA, 25 bp, Mus musculus
tttctgcaacctcacatggcatggc

SEQ ID NO: 970782 - DNA, 25 bp, Mus musculus
tttctgcaacctgacatggcatggc

SEQ ID NO: 970783 - DNA, 25 bp, Mus musculus
tttctgcaagccactaatttaatga

SEQ ID NO: 970784 - DNA, 25 bp, Mus musculus
tttctgcaagcctctaatttaatga

SEQ ID NO: 970785 - DNA, 25 bp, Mus musculus
tttctgcaatgtagctgctcacctt

SEQ ID NO: 970786 - DNA, 25 bp, Mus musculus
tttctgcaatgttgctgctcacctt

SEQ ID NO: 970787 - DNA, 25 bp, Mus musculus
tttctgcaatttctctcactcggta

SEQ ID NO: 970788 - DNA, 25 bp, Mus musculus
tttctgcaatttgtctcactcggta

SEQ ID NO: 970789 - DNA, 25 bp, Mus musculus
tttctgcacacgagggagccgtgag

SEQ ID NO: 970790 - DNA, 25 bp, Mus musculus
tttctgcacacgtgggagccgtgag

SEQ ID NO: 970791 - DNA, 25 bp, Mus musculus
tttctgcacactaacactcctgtga

SEQ ID NO: 970792 - DNA, 25 bp, Mus musculus
tttctgcacacttacactcctgtga

SEQ ID NO: 970793 - DNA, 25 bp, Mus musculus
tttctgcaccgaaggccatcaggga

SEQ ID NO: 970794 - DNA, 25 bp, Mus musculus
tttctgcaccgatggccatcaggga

SEQ ID NO: 970795 - DNA, 25 bp, Mus musculus
tttctgcacctccaatcatacagag

SEQ ID NO: 970796 - DNA, 25 bp, Mus musculus
tttctgcacctcgaatcatacagag

SEQ ID NO: 970797 - DNA, 25 bp, Mus musculus
tttctgcacttgattattcctggcc

SEQ ID NO: 970798 - DNA, 25 bp, Mus musculus
tttctgcacttgtttattcctggcc

SEQ ID NO: 970799 - DNA, 25 bp, Mus musculus
tttctgcagaagatgatgtagtcac

SEQ ID NO: 970800 - DNA, 25 bp, Mus musculus
tttctgcagaagttgatgtagtcac

SEQ ID NO: 970801 - DNA, 25 bp, Mus musculus
tttctgcagaggagttggacgcaca

SEQ ID NO: 970802 - DNA, 25 bp, Mus musculus
tttctgcagaggcactaacagtctc

SEQ ID NO: 970803 - DNA, 25 bp, Mus musculus
tttctgcagagggactaacagtctc

SEQ ID NO: 970804 - DNA, 25 bp, Mus musculus
tttctgcagaggtgttggacgcaca

SEQ ID NO: 970805 - DNA, 25 bp, Mus musculus
tttctgcaggaacagtaagaccata

SEQ ID NO: 970806 - DNA, 25 bp, Mus musculus
tttctgcaggaagagtaagaccata

SEQ ID NO: 970807 - DNA, 25 bp, Mus musculus
tttctgcagggcatcgtctacggag

SEQ ID NO: 970808 - DNA, 25 bp, Mus musculus
tttctgcagggcttcgtctacggag

SEQ ID NO: 970809 - DNA, 25 bp, Mus musculus
tttctgcatccacatagagtgcagc

SEQ ID NO: 970810 - DNA, 25 bp, Mus musculus
tttctgcatccagatagagtgcagc

SEQ ID NO: 970811 - DNA, 25 bp, Mus musculus
tttctgcatcccatcattggcacct

SEQ ID NO: 970812 - DNA, 25 bp, Mus musculus
tttctgcatcccttcattggcacct

SEQ ID NO: 970813 - DNA, 25 bp, Mus musculus
tttctgcatcttctatctggatagt

SEQ ID NO: 970814 - DNA, 25 bp, Mus musculus
tttctgcatcttgtatctggatagt

SEQ ID NO: 970815 - DNA, 25 bp, Mus musculus
tttctgcatgccagcctgaaagcgt

SEQ ID NO: 970816 - DNA, 25 bp, Mus musculus
tttctgcatgcctgcctgaaagcgt

SEQ ID NO: 970817 - DNA, 25 bp, Mus musculus
tttctgcatggtactgggagtacac

SEQ ID NO: 970818 - DNA, 25 bp, Mus musculus
tttctgcatggttctgggagtacac

SEQ ID NO: 970819 - DNA, 25 bp, Mus musculus
tttctgcattttcatcagccatggt

SEQ ID NO: 970820 - DNA, 25 bp, Mus musculus
tttctgcattttgatcagccatggt

SEQ ID NO: 970821 - DNA, 25 bp, Mus musculus
tttctgccaaagatgctcaccaagg

SEQ ID NO: 970822 - DNA, 25 bp, Mus musculus
tttctgccaaagttgctcaccaagg

SEQ ID NO: 970823 - DNA, 25 bp, Mus musculus
tttctgccaactcacatgcgactga

SEQ ID NO: 970824 - DNA, 25 bp, Mus musculus
tttctgccaactgacatgcgactga

SEQ ID NO: 970825 - DNA, 25 bp, Mus musculus
tttctgccagacagagggtgctttt

SEQ ID NO: 970826 - DNA, 25 bp, Mus musculus
tttctgccagactgagggtgctttt

SEQ ID NO: 970827 - DNA, 25 bp, Mus musculus
tttctgccagagacctttaaccttc

SEQ ID NO: 970828 - DNA, 25 bp, Mus musculus
tttctgccagagtcctttaaccttc

SEQ ID NO: 970829 - DNA, 25 bp, Mus musculus
tttctgccagtccttttgtatgcat

SEQ ID NO: 970830 - DNA, 25 bp, Mus musculus
tttctgccagtcgttttgtatgcat

SEQ ID NO: 970831 - DNA, 25 bp, Mus musculus
tttctgccatgtacaaatcacactt

SEQ ID NO: 970832 - DNA, 25 bp, Mus musculus
tttctgccatgttcaaatcacactt

SEQ ID NO: 970833 - DNA, 25 bp, Mus musculus
tttctgcccaagactaaagaggtta

SEQ ID NO: 970834 - DNA, 25 bp, Mus musculus
tttctgcccaagtctaaagaggtta

SEQ ID NO: 970835 - DNA, 25 bp, Mus musculus
tttctgcccatcatcaaggttattt

SEQ ID NO: 970836 - DNA, 25 bp, Mus musculus
tttctgcccatcttcaaggttattt

SEQ ID NO: 970837 - DNA, 25 bp, Mus musculus
tttctgcccatgactgttttgtgga

SEQ ID NO: 970838 - DNA, 25 bp, Mus musculus
tttctgcccatgtctgttttgtgga

SEQ ID NO: 970839 - DNA, 25 bp, Mus musculus
tttctgccccatcaaatgctagctt

SEQ ID NO: 970840 - DNA, 25 bp, Mus musculus
tttctgccccatgaaatgctagctt

SEQ ID NO: 970841 - DNA, 25 bp, Mus musculus
tttctgcccctcactatatactttt

SEQ ID NO: 970842 - DNA, 25 bp, Mus musculus
tttctgcccctcatgctaaagagac

SEQ ID NO: 970843 - DNA, 25 bp, Mus musculus
tttctgcccctctctatatactttt

SEQ ID NO: 970844 - DNA, 25 bp, Mus musculus
tttctgcccctcttgctaaagagac

SEQ ID NO: 970845 - DNA, 25 bp, Mus musculus
tttctgcccgaaagtctacttaaaa

SEQ ID NO: 970846 - DNA, 25 bp, Mus musculus
tttctgcccgaatgtctacttaaaa

SEQ ID NO: 970847 - DNA, 25 bp, Mus musculus
tttctgccctctcgctgaggctggg

SEQ ID NO: 970848 - DNA, 25 bp, Mus musculus
tttctgccctctggctgaggctggg

SEQ ID NO: 970849 - DNA, 25 bp, Mus musculus
tttctgccctgcacatgttttacat

SEQ ID NO: 970850 - DNA, 25 bp, Mus musculus
tttctgccctgctcatgttttacat

SEQ ID NO: 970851 - DNA, 25 bp, Mus musculus
tttctgccctggatgtttgtttagg

SEQ ID NO: 970852 - DNA, 25 bp, Mus musculus
tttctgccctggttgtttgtttagg

SEQ ID NO: 970853 - DNA, 25 bp, Mus musculus
tttctgccctgtaatgattttgaac

SEQ ID NO: 970854 - DNA, 25 bp, Mus musculus
tttctgccctgttatgattttgaac

SEQ ID NO: 970855 - DNA, 25 bp, Mus musculus
tttctgccggacagtggatcccaca

SEQ ID NO: 970856 - DNA, 25 bp, Mus musculus
tttctgccggactgtggatcccaca

SEQ ID NO: 970857 - DNA, 25 bp, Mus musculus
tttctgccggcgctgttttaaatat

SEQ ID NO: 970858 - DNA, 25 bp, Mus musculus
tttctgccggcggtgttttaaatat

SEQ ID NO: 970859 - DNA, 25 bp, Mus musculus
tttctgccggtaaccctgtatgggt

SEQ ID NO: 970860 - DNA, 25 bp, Mus musculus
tttctgccggtatccctgtatgggt

SEQ ID NO: 970861 - DNA, 25 bp, Mus musculus
tttctgccggtgaatcctaattttt

SEQ ID NO: 970862 - DNA, 25 bp, Mus musculus
tttctgccggtgtatcctaattttt

SEQ ID NO: 970863 - DNA, 25 bp, Mus musculus
tttctgccggttaacgtgctaggtt

SEQ ID NO: 970864 - DNA, 25 bp, Mus musculus
tttctgccggtttacgtgctaggtt

SEQ ID NO: 970865 - DNA, 25 bp, Mus musculus
tttctgcctacaccattttcttaat

SEQ ID NO: 970866 - DNA, 25 bp, Mus musculus
tttctgcctacagcattttcttaat

SEQ ID NO: 970867 - DNA, 25 bp, Mus musculus
tttctgcctctcaagtctcatgtta

SEQ ID NO: 970868 - DNA, 25 bp, Mus musculus
tttctgcctctctagtctcatgtta

SEQ ID NO: 970869 - DNA, 25 bp, Mus musculus
tttctgcctgttcacctttaagttc

SEQ ID NO: 970870 - DNA, 25 bp, Mus musculus
tttctgcctgttgacctttaagttc

SEQ ID NO: 970871 - DNA, 25 bp, Mus musculus
tttctgccttccaatgaaccccatt

SEQ ID NO: 970872 - DNA, 25 bp, Mus musculus
tttctgccttccactatgtgaggat

SEQ ID NO: 970873 - DNA, 25 bp, Mus musculus
tttctgccttccagcctcagtttac

SEQ ID NO: 970874 - DNA, 25 bp, Mus musculus
tttctgccttcctatgaaccccatt

SEQ ID NO: 970875 - DNA, 25 bp, Mus musculus
tttctgccttcctctatgtgaggat

SEQ ID NO: 970876 - DNA, 25 bp, Mus musculus
tttctgccttcctgcctcagtttac

SEQ ID NO: 970877 - DNA, 25 bp, Mus musculus
tttctgcgagacagcggaccaatta

SEQ ID NO: 970878 - DNA, 25 bp, Mus musculus
tttctgcgagactgcggaccaatta

SEQ ID NO: 970879 - DNA, 25 bp, Mus musculus
tttctgcggatacctttgacataag

SEQ ID NO: 970880 - DNA, 25 bp, Mus musculus
tttctgcggatagctttgacataag

SEQ ID NO: 970881 - DNA, 25 bp, Mus musculus
tttctgcgtcagagtgagtcatgtg

SEQ ID NO: 970882 - DNA, 25 bp, Mus musculus
tttctgcgtcagtgtgagtcatgtg

SEQ ID NO: 970883 - DNA, 25 bp, Mus musculus
tttctgcgtcataattcattctggg

SEQ ID NO: 970884 - DNA, 25 bp, Mus musculus
tttctgcgtcattattcattctggg

SEQ ID NO: 970885 - DNA, 25 bp, Mus musculus
tttctgcgtgccaggaagaacacca

SEQ ID NO: 970886 - DNA, 25 bp, Mus musculus
tttctgcgtgcctggaagaacacca

SEQ ID NO: 970887 - DNA, 25 bp, Mus musculus
tttctgctacagatgggtttgccca

SEQ ID NO: 970888 - DNA, 25 bp, Mus musculus
tttctgctacagttgggtttgccca

SEQ ID NO: 970889 - DNA, 25 bp, Mus musculus
tttctgctagccaccatgaatacca

SEQ ID NO: 970890 - DNA, 25 bp, Mus musculus
tttctgctagcctccatgaatacca

SEQ ID NO: 970891 - DNA, 25 bp, Mus musculus
tttctgctagtccatctgccagctg

SEQ ID NO: 970892 - DNA, 25 bp, Mus musculus
tttctgctagtcgatctgccagctg

SEQ ID NO: 970893 - DNA, 25 bp, Mus musculus
tttctgctatttcgatgggcttgta

SEQ ID NO: 970894 - DNA, 25 bp, Mus musculus
tttctgctatttggatgggcttgta

SEQ ID NO: 970895 - DNA, 25 bp, Mus musculus
tttctgctccagagaagagaattgt

SEQ ID NO: 970896 - DNA, 25 bp, Mus musculus
tttctgctccagtgaagagaattgt

SEQ ID NO: 970897 - DNA, 25 bp, Mus musculus
tttctgctcctaacctttcaggatt

SEQ ID NO: 970898 - DNA, 25 bp, Mus musculus
tttctgctcctatcctttcaggatt

SEQ ID NO: 970899 - DNA, 25 bp, Mus musculus
tttctgctccttcggcatgactgga

SEQ ID NO: 970900 - DNA, 25 bp, Mus musculus
tttctgctccttgggcatgactgga

SEQ ID NO: 970901 - DNA, 25 bp, Mus musculus
tttctgctctaaagtgtttcccaag

SEQ ID NO: 970902 - DNA, 25 bp, Mus musculus
tttctgctctaatgtgtttcccaag

SEQ ID NO: 970903 - DNA, 25 bp, Mus musculus
tttctgctctctcttacacaatgaa

SEQ ID NO: 970904 - DNA, 25 bp, Mus musculus
tttctgctctctgttacacaatgaa

SEQ ID NO: 970905 - DNA, 25 bp, Mus musculus
tttctgctctttatcgaaatccatt

SEQ ID NO: 970906 - DNA, 25 bp, Mus musculus
tttctgctctttttcgaaatccatt

SEQ ID NO: 970907 - DNA, 25 bp, Mus musculus
tttctgctgagacagtggaaacaat

SEQ ID NO: 970908 - DNA, 25 bp, Mus musculus
tttctgctgagagagtggaaacaat

SEQ ID NO: 970909 - DNA, 25 bp, Mus musculus
tttctgctgcaacgagagcgaggct

SEQ ID NO: 970910 - DNA, 25 bp, Mus musculus
tttctgctgcaaggagagcgaggct

SEQ ID NO: 970911 - DNA, 25 bp, Mus musculus
tttctgctgcacactcttcccatat

SEQ ID NO: 970912 - DNA, 25 bp, Mus musculus
tttctgctgcactctcttcccatat

SEQ ID NO: 970913 - DNA, 25 bp, Mus musculus
tttctgctgcgaaacgaagttcctg

SEQ ID NO: 970914 - DNA, 25 bp, Mus musculus
tttctgctgcgatacgaagttcctg

SEQ ID NO: 970915 - DNA, 25 bp, Mus musculus
tttctgctgcttcgccacggagctt

SEQ ID NO: 970916 - DNA, 25 bp, Mus musculus
tttctgctgcttggccacggagctt

SEQ ID NO: 970917 - DNA, 25 bp, Mus musculus
tttctgctggttacctctaatatct

SEQ ID NO: 970918 - DNA, 25 bp, Mus musculus
tttctgctggttcattggcgctcaa

SEQ ID NO: 970919 - DNA, 25 bp, Mus musculus
tttctgctggttgattggcgctcaa

SEQ ID NO: 970920 - DNA, 25 bp, Mus musculus
tttctgctggtttcctctaatatct

SEQ ID NO: 970921 - DNA, 25 bp, Mus musculus
tttctgctgttgctaccactgtgca

SEQ ID NO: 970922 - DNA, 25 bp, Mus musculus
tttctgctgttggtaccactgtgca

SEQ ID NO: 970923 - DNA, 25 bp, Mus musculus
tttctgcttaaaaagatttctatat

SEQ ID NO: 970924 - DNA, 25 bp, Mus musculus
tttctgcttaaatagatttctatat

SEQ ID NO: 970925 - DNA, 25 bp, Mus musculus
tttctgcttaggagggttggcttct

SEQ ID NO: 970926 - DNA, 25 bp, Mus musculus
tttctgcttaggtgggttggcttct

SEQ ID NO: 970927 - DNA, 25 bp, Mus musculus
tttctgcttcacaggtctctagcca

SEQ ID NO: 970928 - DNA, 25 bp, Mus musculus
tttctgcttcactggtctctagcca

SEQ ID NO: 970929 - DNA, 25 bp, Mus musculus
tttctgcttcctcaatctgcaagga

SEQ ID NO: 970930 - DNA, 25 bp, Mus musculus
tttctgcttcctgaatctgcaagga

SEQ ID NO: 970931 - DNA, 25 bp, Mus musculus
tttctgcttctaacccattatttcc

SEQ ID NO: 970932 - DNA, 25 bp, Mus musculus
tttctgcttctatcccattatttcc

SEQ ID NO: 970933 - DNA, 25 bp, Mus musculus
tttctgcttgcacgaagtccaggcc

SEQ ID NO: 970934 - DNA, 25 bp, Mus musculus
tttctgcttgcaggaagtccaggcc

SEQ ID NO: 970935 - DNA, 25 bp, Mus musculus
tttctgctttccaactgtcttatta

SEQ ID NO: 970936 - DNA, 25 bp, Mus musculus
tttctgctttcctactgtcttatta

SEQ ID NO: 970937 - DNA, 25 bp, Mus musculus
tttctgctttgtctcttgaagaact

SEQ ID NO: 970938 - DNA, 25 bp, Mus musculus
tttctgctttgtgtcttgaagaact

SEQ ID NO: 970939 - DNA, 25 bp, Mus musculus
tttctgctttttaccttagctcttt

SEQ ID NO: 970940 - DNA, 25 bp, Mus musculus
tttctgctttttagaatctcctagg

SEQ ID NO: 970941 - DNA, 25 bp, Mus musculus
tttctgcttttttccttagctcttt

SEQ ID NO: 970942 - DNA, 25 bp, Mus musculus
tttctgcttttttgaatctcctagg

SEQ ID NO: 970943 - DNA, 25 bp, Mus musculus
tttctggaacaacacccaaatggtg

SEQ ID NO: 970944 - DNA, 25 bp, Mus musculus
tttctggaacaagacccaaatggtg

SEQ ID NO: 970945 - DNA, 25 bp, Mus musculus
tttctggaacagaaggtctctcctg

SEQ ID NO: 970946 - DNA, 25 bp, Mus musculus
tttctggaacagtaggtctctcctg

SEQ ID NO: 970947 - DNA, 25 bp, Mus musculus
tttctggaactcagccccaggatga

SEQ ID NO: 970948 - DNA, 25 bp, Mus musculus
tttctggaactctgccccaggatga

SEQ ID NO: 970949 - DNA, 25 bp, Mus musculus
tttctggaactgagctttcaggagg

SEQ ID NO: 970950 - DNA, 25 bp, Mus musculus
tttctggaactgtgctttcaggagg

SEQ ID NO: 970951 - DNA, 25 bp, Mus musculus
tttctggaatgtcagctggcctgat

SEQ ID NO: 970952 - DNA, 25 bp, Mus musculus
tttctggaatgtgagctggcctgat

SEQ ID NO: 970953 - DNA, 25 bp, Mus musculus
tttctggaccttctttggtgcaacc

SEQ ID NO: 970954 - DNA, 25 bp, Mus musculus
tttctggaccttgtttggtgcaacc

SEQ ID NO: 970955 - DNA, 25 bp, Mus musculus
tttctggactacaatctttcacagg

SEQ ID NO: 970956 - DNA, 25 bp, Mus musculus
tttctggactactatctttcacagg

SEQ ID NO: 970957 - DNA, 25 bp, Mus musculus
tttctggactctcttgccagcattt

SEQ ID NO: 970958 - DNA, 25 bp, Mus musculus
tttctggactctgttgccagcattt

SEQ ID NO: 970959 - DNA, 25 bp, Mus musculus
tttctggactgtctgcagcagttca

SEQ ID NO: 970960 - DNA, 25 bp, Mus musculus
tttctggactgtgtgcagcagttca

SEQ ID NO: 970961 - DNA, 25 bp, Mus musculus
tttctggagaccatttaatgtgata

SEQ ID NO: 970962 - DNA, 25 bp, Mus musculus
tttctggagaccttttaatgtgata

SEQ ID NO: 970963 - DNA, 25 bp, Mus musculus
tttctggagctcagtgcaaggcgac

SEQ ID NO: 970964 - DNA, 25 bp, Mus musculus
tttctggagctctgtgcaaggcgac

SEQ ID NO: 970965 - DNA, 25 bp, Mus musculus
tttctggatagtcgccacaggtcct

SEQ ID NO: 970966 - DNA, 25 bp, Mus musculus
tttctggatagtggccacaggtcct

SEQ ID NO: 970967 - DNA, 25 bp, Mus musculus
tttctggatcgactggaccacaggc

SEQ ID NO: 970968 - DNA, 25 bp, Mus musculus
tttctggatcgagtggaccacaggc

SEQ ID NO: 970969 - DNA, 25 bp, Mus musculus
tttctggattggaacctgaatatgt

SEQ ID NO: 970970 - DNA, 25 bp, Mus musculus
tttctggattggtacctgaatatgt

SEQ ID NO: 970971 - DNA, 25 bp, Mus musculus
tttctggcatccagcagggttttct

SEQ ID NO: 970972 - DNA, 25 bp, Mus musculus
tttctggcatcctgcagggttttct

SEQ ID NO: 970973 - DNA, 25 bp, Mus musculus
tttctggcatctagggttttcttac

SEQ ID NO: 970974 - DNA, 25 bp, Mus musculus
tttctggcatcttgggttttcttac

SEQ ID NO: 970975 - DNA, 25 bp, Mus musculus
tttctggcatgaccgaggttccgca

SEQ ID NO: 970976 - DNA, 25 bp, Mus musculus
tttctggcatgagcgaggttccgca

SEQ ID NO: 970977 - DNA, 25 bp, Mus musculus
tttctggcattcacctgcagttgag

SEQ ID NO: 970978 - DNA, 25 bp, Mus musculus
tttctggcattctcctgcagttgag

SEQ ID NO: 970979 - DNA, 25 bp, Mus musculus
tttctggccactactaacatgttct

SEQ ID NO: 970980 - DNA, 25 bp, Mus musculus
tttctggccacttctaacatgttct

SEQ ID NO: 970981 - DNA, 25 bp, Mus musculus
tttctggccagacggaccaactcca

SEQ ID NO: 970982 - DNA, 25 bp, Mus musculus
tttctggccagagggaccaactcca

SEQ ID NO: 970983 - DNA, 25 bp, Mus musculus
tttctggccatacttgccgaagtca

SEQ ID NO: 970984 - DNA, 25 bp, Mus musculus
tttctggccatagttgccgaagtca

SEQ ID NO: 970985 - DNA, 25 bp, Mus musculus
tttctggccattccctggcagcttt

SEQ ID NO: 970986 - DNA, 25 bp, Mus musculus
tttctggccattgcctggcagcttt

SEQ ID NO: 970987 - DNA, 25 bp, Mus musculus
tttctggcccatcctttaaggacag

SEQ ID NO: 970988 - DNA, 25 bp, Mus musculus
tttctggcccatgctttaaggacag

SEQ ID NO: 970989 - DNA, 25 bp, Mus musculus
tttctggccctcaaataatttctaa

SEQ ID NO: 970990 - DNA, 25 bp, Mus musculus
tttctggccctcacagttttggcac

SEQ ID NO: 970991 - DNA, 25 bp, Mus musculus
tttctggccctctaataatttctaa

SEQ ID NO: 970992 - DNA, 25 bp, Mus musculus
tttctggccctctcagttttggcac

SEQ ID NO: 970993 - DNA, 25 bp, Mus musculus
tttctggccgcactaaccagtataa

SEQ ID NO: 970994 - DNA, 25 bp, Mus musculus
tttctggccgcagtaaccagtataa

SEQ ID NO: 970995 - DNA, 25 bp, Mus musculus
tttctggcctcccatggtgacatta

SEQ ID NO: 970996 - DNA, 25 bp, Mus musculus
tttctggcctccgatggtgacatta

SEQ ID NO: 970997 - DNA, 25 bp, Mus musculus
tttctggcctctatggtggcagtta

SEQ ID NO: 970998 - DNA, 25 bp, Mus musculus
tttctggcctctttggtggcagtta

SEQ ID NO: 970999 - DNA, 25 bp, Mus musculus
tttctggcggctcactggtacctgg

SEQ ID NO: 971000 - DNA, 25 bp, Mus musculus
tttctggcggctgactggtacctgg

SEQ ID NO: 971001 - DNA, 25 bp, Mus musculus
tttctggctaccaaaacggttctca

SEQ ID NO: 971002 - DNA, 25 bp, Mus musculus
tttctggctacctaaacggttctca

SEQ ID NO: 971003 - DNA, 25 bp, Mus musculus
tttctggctcatctgaggtgctagt

SEQ ID NO: 971004 - DNA, 25 bp, Mus musculus
tttctggctcatgtgaggtgctagt

SEQ ID NO: 971005 - DNA, 25 bp, Mus musculus
tttctgggacctaaaatgcctggat

SEQ ID NO: 971006 - DNA, 25 bp, Mus musculus
tttctgggaccttaaatgcctggat

SEQ ID NO: 971007 - DNA, 25 bp, Mus musculus
tttctgggatcaatgttttccccat

SEQ ID NO: 971008 - DNA, 25 bp, Mus musculus
tttctgggatcattgttttccccat

SEQ ID NO: 971009 - DNA, 25 bp, Mus musculus
tttctgggcaggctagacctcaggc

SEQ ID NO: 971010 - DNA, 25 bp, Mus musculus
tttctgggcagggtagacctcaggc

SEQ ID NO: 971011 - DNA, 25 bp, Mus musculus
tttctgggccaactgctgcttctgt

SEQ ID NO: 971012 - DNA, 25 bp, Mus musculus
tttctgggccaagtgctgcttctgt

SEQ ID NO: 971013 - DNA, 25 bp, Mus musculus
tttctgggctatcattctcatctgc

SEQ ID NO: 971014 - DNA, 25 bp, Mus musculus
tttctgggctatgattctcatctgc

SEQ ID NO: 971015 - DNA, 25 bp, Mus musculus
tttctgggctccagagtacgtccaa

SEQ ID NO: 971016 - DNA, 25 bp, Mus musculus
tttctgggctcctgagtacgtccaa

SEQ ID NO: 971017 - DNA, 25 bp, Mus musculus
tttctgggctctcgtttagcatggc

SEQ ID NO: 971018 - DNA, 25 bp, Mus musculus
tttctgggctctggtttagcatggc

SEQ ID NO: 971019 - DNA, 25 bp, Mus musculus
tttctgggtagaacgctttgttagg

SEQ ID NO: 971020 - DNA, 25 bp, Mus musculus
tttctgggtagatcgctttgttagg

SEQ ID NO: 971021 - DNA, 25 bp, Mus musculus
tttctgggtcagatttcttctcttg

SEQ ID NO: 971022 - DNA, 25 bp, Mus musculus
tttctgggtcagttttcttctcttg

SEQ ID NO: 971023 - DNA, 25 bp, Mus musculus
tttctgggtcctaccgtgccaagga

SEQ ID NO: 971024 - DNA, 25 bp, Mus musculus
tttctgggtccttccgtgccaagga

SEQ ID NO: 971025 - DNA, 25 bp, Mus musculus
tttctgggtgagcttatgtccctgc

SEQ ID NO: 971026 - DNA, 25 bp, Mus musculus
tttctgggtgaggttatgtccctgc

SEQ ID NO: 971027 - DNA, 25 bp, Mus musculus
tttctgggtgatcccatgttctttg

SEQ ID NO: 971028 - DNA, 25 bp, Mus musculus
tttctgggtgatgccatgttctttg

SEQ ID NO: 971029 - DNA, 25 bp, Mus musculus
tttctggtacctagttcaacattct

SEQ ID NO: 971030 - DNA, 25 bp, Mus musculus
tttctggtaccttgttcaacattct

SEQ ID NO: 971031 - DNA, 25 bp, Mus musculus
tttctggtcaacatccaagaacgtt

SEQ ID NO: 971032 - DNA, 25 bp, Mus musculus
tttctggtcaacttccaagaacgtt

SEQ ID NO: 971033 - DNA, 25 bp, Mus musculus
tttctggtccagaaatgagcttatg

SEQ ID NO: 971034 - DNA, 25 bp, Mus musculus
tttctggtccagtaatgagcttatg

SEQ ID NO: 971035 - DNA, 25 bp, Mus musculus
tttctggtctccctattttcaatga

SEQ ID NO: 971036 - DNA, 25 bp, Mus musculus
tttctggtctccgtattttcaatga

SEQ ID NO: 971037 - DNA, 25 bp, Mus musculus
tttctggtcttactcatccgacaaa

SEQ ID NO: 971038 - DNA, 25 bp, Mus musculus
tttctggtcttagtcatccgacaaa

SEQ ID NO: 971039 - DNA, 25 bp, Mus musculus
tttctggtgcagatcctatctacat

SEQ ID NO: 971040 - DNA, 25 bp, Mus musculus
tttctggtgcagttcctatctacat

SEQ ID NO: 971041 - DNA, 25 bp, Mus musculus
tttctggtggaaattgggcccctgt

SEQ ID NO: 971042 - DNA, 25 bp, Mus musculus
tttctggtggaatttgggcccctgt

SEQ ID NO: 971043 - DNA, 25 bp, Mus musculus
tttctggtgtgcagaccttttcctt

SEQ ID NO: 971044 - DNA, 25 bp, Mus musculus
tttctggtgtgctgaccttttcctt

SEQ ID NO: 971045 - DNA, 25 bp, Mus musculus
tttctggtgtgtactactgctctga

SEQ ID NO: 971046 - DNA, 25 bp, Mus musculus
tttctggtgtgttctactgctctga

SEQ ID NO: 971047 - DNA, 25 bp, Mus musculus
tttctggttactcttgtgtggctgc

SEQ ID NO: 971048 - DNA, 25 bp, Mus musculus
tttctggttactgttgtgtggctgc

SEQ ID NO: 971049 - DNA, 25 bp, Mus musculus
tttctggttgaccttgggcttctca

SEQ ID NO: 971050 - DNA, 25 bp, Mus musculus
tttctggttgacgttgggcttctca

SEQ ID NO: 971051 - DNA, 25 bp, Mus musculus
tttctggtttgccaggagcatccac

SEQ ID NO: 971052 - DNA, 25 bp, Mus musculus
tttctggtttgcgaggagcatccac

SEQ ID NO: 971053 - DNA, 25 bp, Mus musculus
tttctggttttgctcaagttgaaga

SEQ ID NO: 971054 - DNA, 25 bp, Mus musculus
tttctggttttgctgacaccccaag

SEQ ID NO: 971055 - DNA, 25 bp, Mus musculus
tttctggttttggtcaagttgaaga

SEQ ID NO: 971056 - DNA, 25 bp, Mus musculus
tttctggttttggtgacaccccaag

SEQ ID NO: 971057 - DNA, 25 bp, Mus musculus
tttctggtttttcttgcctcccaat

SEQ ID NO: 971058 - DNA, 25 bp, Mus musculus
tttctggtttttgttgcctcccaat

SEQ ID NO: 971059 - DNA, 25 bp, Mus musculus
tttctgtaacagatgcatatggcta

SEQ ID NO: 971060 - DNA, 25 bp, Mus musculus
tttctgtaacagttgcatatggcta

SEQ ID NO: 971061 - DNA, 25 bp, Mus musculus
tttctgtaatagctctcattaaatc

SEQ ID NO: 971062 - DNA, 25 bp, Mus musculus
tttctgtaataggtctcattaaatc

SEQ ID NO: 971063 - DNA, 25 bp, Mus musculus
tttctgtacatgaggctttatttaa

SEQ ID NO: 971064 - DNA, 25 bp, Mus musculus
tttctgtacatgtggctttatttaa

SEQ ID NO: 971065 - DNA, 25 bp, Mus musculus
tttctgtaccgcacaagatggtgct

SEQ ID NO: 971066 - DNA, 25 bp, Mus musculus
tttctgtaccgctcaagatggtgct

SEQ ID NO: 971067 - DNA, 25 bp, Mus musculus
tttctgtacctcattgtactcagag

SEQ ID NO: 971068 - DNA, 25 bp, Mus musculus
tttctgtacctctttgtactcagag

SEQ ID NO: 971069 - DNA, 25 bp, Mus musculus
tttctgtactccagctcatcagtat

SEQ ID NO: 971070 - DNA, 25 bp, Mus musculus
tttctgtactcctgctcatcagtat

SEQ ID NO: 971071 - DNA, 25 bp, Mus musculus
tttctgtactctaatcccatgtttc

SEQ ID NO: 971072 - DNA, 25 bp, Mus musculus
tttctgtactcttatcccatgtttc

SEQ ID NO: 971073 - DNA, 25 bp, Mus musculus
tttctgtactttccccctgtgaagt

SEQ ID NO: 971074 - DNA, 25 bp, Mus musculus
tttctgtactttgcccctgtgaagt

SEQ ID NO: 971075 - DNA, 25 bp, Mus musculus
tttctgtaggacattgcatagtaac

SEQ ID NO: 971076 - DNA, 25 bp, Mus musculus
tttctgtaggactttgcatagtaac

SEQ ID NO: 971077 - DNA, 25 bp, Mus musculus
tttctgtagtggctgttctgggtcc

SEQ ID NO: 971078 - DNA, 25 bp, Mus musculus
tttctgtagtgggtgttctgggtcc

SEQ ID NO: 971079 - DNA, 25 bp, Mus musculus
tttctgtatctccttgcctatatct

SEQ ID NO: 971080 - DNA, 25 bp, Mus musculus
tttctgtatctcgttgcctatatct

SEQ ID NO: 971081 - DNA, 25 bp, Mus musculus
tttctgtatttgactcggcctggtt

SEQ ID NO: 971082 - DNA, 25 bp, Mus musculus
tttctgtatttgtctcggcctggtt

SEQ ID NO: 971083 - DNA, 25 bp, Mus musculus
tttctgtcaactctcttcagcttac

SEQ ID NO: 971084 - DNA, 25 bp, Mus musculus
tttctgtcaactgtcttcagcttac

SEQ ID NO: 971085 - DNA, 25 bp, Mus musculus
tttctgtcacatagtggcagcacct

SEQ ID NO: 971086 - DNA, 25 bp, Mus musculus
tttctgtcacattgtggcagcacct

SEQ ID NO: 971087 - DNA, 25 bp, Mus musculus
tttctgtcagatagctttcagggat

SEQ ID NO: 971088 - DNA, 25 bp, Mus musculus
tttctgtcagatcctccaaacacac

SEQ ID NO: 971089 - DNA, 25 bp, Mus musculus
tttctgtcagatgctccaaacacac

SEQ ID NO: 971090 - DNA, 25 bp, Mus musculus
tttctgtcagattgctttcagggat

SEQ ID NO: 971091 - DNA, 25 bp, Mus musculus
tttctgtcaggacaatcccagctct

SEQ ID NO: 971092 - DNA, 25 bp, Mus musculus
tttctgtcaggagaatcccagctct

SEQ ID NO: 971093 - DNA, 25 bp, Mus musculus
tttctgtccacgagcgaggtgctga

SEQ ID NO: 971094 - DNA, 25 bp, Mus musculus
tttctgtccacgtgcgaggtgctga

SEQ ID NO: 971095 - DNA, 25 bp, Mus musculus
tttctgtccattcccaaagaccggc

SEQ ID NO: 971096 - DNA, 25 bp, Mus musculus
tttctgtccattgccaaagaccggc

SEQ ID NO: 971097 - DNA, 25 bp, Mus musculus
tttctgtcccaaacctagcaagtag

SEQ ID NO: 971098 - DNA, 25 bp, Mus musculus
tttctgtcccaatcctagcaagtag

SEQ ID NO: 971099 - DNA, 25 bp, Mus musculus
tttctgtcccacacaaatgcacaaa

SEQ ID NO: 971100 - DNA, 25 bp, Mus musculus
tttctgtcccactcaaatgcacaaa

SEQ ID NO: 971101 - DNA, 25 bp, Mus musculus
tttctgtcctgtaggcagctgatgg

SEQ ID NO: 971102 - DNA, 25 bp, Mus musculus
tttctgtcctgttggcagctgatgg

SEQ ID NO: 971103 - DNA, 25 bp, Mus musculus
tttctgtccttacttggcctgagtt

SEQ ID NO: 971104 - DNA, 25 bp, Mus musculus
tttctgtccttagttggcctgagtt

SEQ ID NO: 971105 - DNA, 25 bp, Mus musculus
tttctgtcgtctatcatgttggtga

SEQ ID NO: 971106 - DNA, 25 bp, Mus musculus
tttctgtcgtctttcatgttggtga

SEQ ID NO: 971107 - DNA, 25 bp, Mus musculus
tttctgtctaagcttgatgggaaga

SEQ ID NO: 971108 - DNA, 25 bp, Mus musculus
tttctgtctaaggttgatgggaaga

SEQ ID NO: 971109 - DNA, 25 bp, Mus musculus
tttctgtctctacctatgaggtgct

SEQ ID NO: 971110 - DNA, 25 bp, Mus musculus
tttctgtctctagctatgaggtgct

SEQ ID NO: 971111 - DNA, 25 bp, Mus musculus
tttctgtctgatcctgtttcctctt

SEQ ID NO: 971112 - DNA, 25 bp, Mus musculus
tttctgtctgatgctgtttcctctt

SEQ ID NO: 971113 - DNA, 25 bp, Mus musculus
tttctgtctggaattcctgccctga

SEQ ID NO: 971114 - DNA, 25 bp, Mus musculus
tttctgtctggatttcctgccctga

SEQ ID NO: 971115 - DNA, 25 bp, Mus musculus
tttctgtctgttccctgttttaaat

SEQ ID NO: 971116 - DNA, 25 bp, Mus musculus
tttctgtctgttgcctgttttaaat

SEQ ID NO: 971117 - DNA, 25 bp, Mus musculus
tttctgtcttatatagtgttagggc

SEQ ID NO: 971118 - DNA, 25 bp, Mus musculus
tttctgtcttatttagtgttagggc

SEQ ID NO: 971119 - DNA, 25 bp, Mus musculus
tttctgtcttgccaacaactgcaga

SEQ ID NO: 971120 - DNA, 25 bp, Mus musculus
tttctgtcttgcgaacaactgcaga

SEQ ID NO: 971121 - DNA, 25 bp, Mus musculus
tttctgtcttggagatacttccttc

SEQ ID NO: 971122 - DNA, 25 bp, Mus musculus
tttctgtcttggtgatacttccttc

SEQ ID NO: 971123 - DNA, 25 bp, Mus musculus
tttctgtctttaaaagttctgcagt

SEQ ID NO: 971124 - DNA, 25 bp, Mus musculus
tttctgtctttataagttctgcagt

SEQ ID NO: 971125 - DNA, 25 bp, Mus musculus
tttctgtgaaccatcgggcagcttt

SEQ ID NO: 971126 - DNA, 25 bp, Mus musculus
tttctgtgaaccttcgggcagcttt

SEQ ID NO: 971127 - DNA, 25 bp, Mus musculus
tttctgtgaagaactatgcttgtaa

SEQ ID NO: 971128 - DNA, 25 bp, Mus musculus
tttctgtgaagatctatgcttgtaa

SEQ ID NO: 971129 - DNA, 25 bp, Mus musculus
tttctgtgaccgacccacttttcat

SEQ ID NO: 971130 - DNA, 25 bp, Mus musculus
tttctgtgaccgtcccacttttcat

SEQ ID NO: 971131 - DNA, 25 bp, Mus musculus
tttctgtgacgtatggaacccataa

SEQ ID NO: 971132 - DNA, 25 bp, Mus musculus
tttctgtgacgtttggaacccataa

SEQ ID NO: 971133 - DNA, 25 bp, Mus musculus
tttctgtgactaaagctcagttggc

SEQ ID NO: 971134 - DNA, 25 bp, Mus musculus
tttctgtgactatagctcagttggc

SEQ ID NO: 971135 - DNA, 25 bp, Mus musculus
tttctgtgactcacttttccaaagg

SEQ ID NO: 971136 - DNA, 25 bp, Mus musculus
tttctgtgactctcttttccaaagg

SEQ ID NO: 971137 - DNA, 25 bp, Mus musculus
tttctgtgagcacactaaaagcaaa

SEQ ID NO: 971138 - DNA, 25 bp, Mus musculus
tttctgtgagcagactaaaagcaaa

SEQ ID NO: 971139 - DNA, 25 bp, Mus musculus
tttctgtgagccaggtttgggtcct

SEQ ID NO: 971140 - DNA, 25 bp, Mus musculus
tttctgtgagcctggtttgggtcct

SEQ ID NO: 971141 - DNA, 25 bp, Mus musculus
tttctgtgatatatatgtaccatga

SEQ ID NO: 971142 - DNA, 25 bp, Mus musculus
tttctgtgatatttatgtaccatga

SEQ ID NO: 971143 - DNA, 25 bp, Mus musculus
tttctgtgatctactattctttggg

SEQ ID NO: 971144 - DNA, 25 bp, Mus musculus
tttctgtgatcttctattctttggg

SEQ ID NO: 971145 - DNA, 25 bp, Mus musculus
tttctgtgatggcaagcgagtagca

SEQ ID NO: 971146 - DNA, 25 bp, Mus musculus
tttctgtgatgggaagcgagtagca

SEQ ID NO: 971147 - DNA, 25 bp, Mus musculus
tttctgtgcagacggacacctgctg

SEQ ID NO: 971148 - DNA, 25 bp, Mus musculus
tttctgtgcagagggacacctgctg

SEQ ID NO: 971149 - DNA, 25 bp, Mus musculus
tttctgtgcaggatcaggctgaccc

SEQ ID NO: 971150 - DNA, 25 bp, Mus musculus
tttctgtgcaggttcaggctgaccc

SEQ ID NO: 971151 - DNA, 25 bp, Mus musculus
tttctgtgcatcatttgaaccccat

SEQ ID NO: 971152 - DNA, 25 bp, Mus musculus
tttctgtgcatcttttgaaccccat

SEQ ID NO: 971153 - DNA, 25 bp, Mus musculus
tttctgtgccacctttgattcattt

SEQ ID NO: 971154 - DNA, 25 bp, Mus musculus
tttctgtgccacgtttgattcattt

SEQ ID NO: 971155 - DNA, 25 bp, Mus musculus
tttctgtgcccaagaattgtatttt

SEQ ID NO: 971156 - DNA, 25 bp, Mus musculus
tttctgtgcccatgaattgtatttt

SEQ ID NO: 971157 - DNA, 25 bp, Mus musculus
tttctgtgcctaacgattttcataa

SEQ ID NO: 971158 - DNA, 25 bp, Mus musculus
tttctgtgcctatcgattttcataa

SEQ ID NO: 971159 - DNA, 25 bp, Mus musculus
tttctgtgctcaatcttcaggcaac

SEQ ID NO: 971160 - DNA, 25 bp, Mus musculus
tttctgtgctcattcttcaggcaac

SEQ ID NO: 971161 - DNA, 25 bp, Mus musculus
tttctgtggaatacttaatgttttt

SEQ ID NO: 971162 - DNA, 25 bp, Mus musculus
tttctgtggaattcttaatgttttt

SEQ ID NO: 971163 - DNA, 25 bp, Mus musculus
tttctgtggcagcatttctcataaa

SEQ ID NO: 971164 - DNA, 25 bp, Mus musculus
tttctgtggcaggatttctcataaa

SEQ ID NO: 971165 - DNA, 25 bp, Mus musculus
tttctgtgggaacccgataaatgcc

SEQ ID NO: 971166 - DNA, 25 bp, Mus musculus
tttctgtgggaagccgataaatgcc

SEQ ID NO: 971167 - DNA, 25 bp, Mus musculus
tttctgtggttcagtttttgctttt

SEQ ID NO: 971168 - DNA, 25 bp, Mus musculus
tttctgtggttctgtttttgctttt

SEQ ID NO: 971169 - DNA, 25 bp, Mus musculus
tttctgtgtactctgtcttctctgt

SEQ ID NO: 971170 - DNA, 25 bp, Mus musculus
tttctgtgtactgtgtcttctctgt

SEQ ID NO: 971171 - DNA, 25 bp, Mus musculus
tttctgtgtataaatcctttgtcat

SEQ ID NO: 971172 - DNA, 25 bp, Mus musculus
tttctgtgtatatatcctttgtcat

SEQ ID NO: 971173 - DNA, 25 bp, Mus musculus
tttctgtgtcttagtctctgactcc

SEQ ID NO: 971174 - DNA, 25 bp, Mus musculus
tttctgtgtcttcctgaaactgcag

SEQ ID NO: 971175 - DNA, 25 bp, Mus musculus
tttctgtgtcttgctgaaactgcag

SEQ ID NO: 971176 - DNA, 25 bp, Mus musculus
tttctgtgtctttgtctctgactcc

SEQ ID NO: 971177 - DNA, 25 bp, Mus musculus
tttctgtgtgtgaaacagctgcaca

SEQ ID NO: 971178 - DNA, 25 bp, Mus musculus
tttctgtgtgtgtaacagctgcaca

SEQ ID NO: 971179 - DNA, 25 bp, Mus musculus
tttctgtgttcgaggacagctatac

SEQ ID NO: 971180 - DNA, 25 bp, Mus musculus
tttctgtgttcgtggacagctatac

SEQ ID NO: 971181 - DNA, 25 bp, Mus musculus
tttctgtgttggcattgtcttctca

SEQ ID NO: 971182 - DNA, 25 bp, Mus musculus
tttctgtgttgggattgtcttctca

SEQ ID NO: 971183 - DNA, 25 bp, Mus musculus
tttctgttacccaatctcttactta

SEQ ID NO: 971184 - DNA, 25 bp, Mus musculus
tttctgttacccagctttgggagaa

SEQ ID NO: 971185 - DNA, 25 bp, Mus musculus
tttctgttaccctatctcttactta

SEQ ID NO: 971186 - DNA, 25 bp, Mus musculus
tttctgttaccctgctttgggagaa

SEQ ID NO: 971187 - DNA, 25 bp, Mus musculus
tttctgttatagagtcttgctactc

SEQ ID NO: 971188 - DNA, 25 bp, Mus musculus
tttctgttatagtgtcttgctactc

SEQ ID NO: 971189 - DNA, 25 bp, Mus musculus
tttctgttatccaaaatcactcatg

SEQ ID NO: 971190 - DNA, 25 bp, Mus musculus
tttctgttatcctaaatcactcatg

SEQ ID NO: 971191 - DNA, 25 bp, Mus musculus
tttctgttcaaaacaccatgcctga

SEQ ID NO: 971192 - DNA, 25 bp, Mus musculus
tttctgttcaaatcaccatgcctga

SEQ ID NO: 971193 - DNA, 25 bp, Mus musculus
tttctgttcagccattccttggtta

SEQ ID NO: 971194 - DNA, 25 bp, Mus musculus
tttctgttcagcgattccttggtta

SEQ ID NO: 971195 - DNA, 25 bp, Mus musculus
tttctgttcagtattttctccctag

SEQ ID NO: 971196 - DNA, 25 bp, Mus musculus
tttctgttcagttttttctccctag

SEQ ID NO: 971197 - DNA, 25 bp, Mus musculus
tttctgttccaaatgagcccaaagg

SEQ ID NO: 971198 - DNA, 25 bp, Mus musculus
tttctgttccaattgagcccaaagg

SEQ ID NO: 971199 - DNA, 25 bp, Mus musculus
tttctgttccacatttcgctcggaa

SEQ ID NO: 971200 - DNA, 25 bp, Mus musculus
tttctgttccacttttcgctcggaa

SEQ ID NO: 971201 - DNA, 25 bp, Mus musculus
tttctgttccctcataagatgatgg

SEQ ID NO: 971202 - DNA, 25 bp, Mus musculus
tttctgttccctgataagatgatgg

SEQ ID NO: 971203 - DNA, 25 bp, Mus musculus
tttctgttcctgaaacgttcgacta

SEQ ID NO: 971204 - DNA, 25 bp, Mus musculus
tttctgttcctgactctgagcccag

SEQ ID NO: 971205 - DNA, 25 bp, Mus musculus
tttctgttcctgtaacgttcgacta

SEQ ID NO: 971206 - DNA, 25 bp, Mus musculus
tttctgttcctgtctctgagcccag

SEQ ID NO: 971207 - DNA, 25 bp, Mus musculus
tttctgttcgatatgctcctgtgca

SEQ ID NO: 971208 - DNA, 25 bp, Mus musculus
tttctgttcgatcaaatttttatgg

SEQ ID NO: 971209 - DNA, 25 bp, Mus musculus
tttctgttcgatgaaatttttatgg

SEQ ID NO: 971210 - DNA, 25 bp, Mus musculus
tttctgttcgatttgctcctgtgca

SEQ ID NO: 971211 - DNA, 25 bp, Mus musculus
tttctgttctccacctatcaaatgt

SEQ ID NO: 971212 - DNA, 25 bp, Mus musculus
tttctgttctcctcctatcaaatgt

SEQ ID NO: 971213 - DNA, 25 bp, Mus musculus
tttctgttctgaagatacaatgtcc

SEQ ID NO: 971214 - DNA, 25 bp, Mus musculus
tttctgttctgatgatacaatgtcc

SEQ ID NO: 971215 - DNA, 25 bp, Mus musculus
tttctgttcttcatgatcccatcaa

SEQ ID NO: 971216 - DNA, 25 bp, Mus musculus
tttctgttcttcatggggcctttca

SEQ ID NO: 971217 - DNA, 25 bp, Mus musculus
tttctgttcttcttgatcccatcaa

SEQ ID NO: 971218 - DNA, 25 bp, Mus musculus
tttctgttcttcttggggcctttca

SEQ ID NO: 971219 - DNA, 25 bp, Mus musculus
tttctgttgccacggaatcactgga

SEQ ID NO: 971220 - DNA, 25 bp, Mus musculus
tttctgttgccagggaatcactgga

SEQ ID NO: 971221 - DNA, 25 bp, Mus musculus
tttctgttgcgaagaagatgctgca

SEQ ID NO: 971222 - DNA, 25 bp, Mus musculus
tttctgttgcgatgaagatgctgca

SEQ ID NO: 971223 - DNA, 25 bp, Mus musculus
tttctgttggtcagcattgtcactg

SEQ ID NO: 971224 - DNA, 25 bp, Mus musculus
tttctgttggtctgcattgtcactg

SEQ ID NO: 971225 - DNA, 25 bp, Mus musculus
tttctgttgtgccaaaattttcctt

SEQ ID NO: 971226 - DNA, 25 bp, Mus musculus
tttctgttgtgcgaaaattttcctt

SEQ ID NO: 971227 - DNA, 25 bp, Mus musculus
tttctgttgtttactctgcttggga

SEQ ID NO: 971228 - DNA, 25 bp, Mus musculus
tttctgttgtttctcctgcgccttt

SEQ ID NO: 971229 - DNA, 25 bp, Mus musculus
tttctgttgtttgtcctgcgccttt

SEQ ID NO: 971230 - DNA, 25 bp, Mus musculus
tttctgttgttttctctgcttggga

SEQ ID NO: 971231 - DNA, 25 bp, Mus musculus
tttctgtttaatcgcaagtattgtt

SEQ ID NO: 971232 - DNA, 25 bp, Mus musculus
tttctgtttaatggcaagtattgtt

SEQ ID NO: 971233 - DNA, 25 bp, Mus musculus
tttctgtttcacacattaacccact

SEQ ID NO: 971234 - DNA, 25 bp, Mus musculus
tttctgtttcactcattaacccact

SEQ ID NO: 971235 - DNA, 25 bp, Mus musculus
tttctgtttcccacctcagtactcg

SEQ ID NO: 971236 - DNA, 25 bp, Mus musculus
tttctgtttccctcctcagtactcg

SEQ ID NO: 971237 - DNA, 25 bp, Mus musculus
tttctgtttcgtagtcttgtatatg

SEQ ID NO: 971238 - DNA, 25 bp, Mus musculus
tttctgtttcgttgtcttgtatatg

SEQ ID NO: 971239 - DNA, 25 bp, Mus musculus
tttctgtttcttcctgtgtgttaca

SEQ ID NO: 971240 - DNA, 25 bp, Mus musculus
tttctgtttcttgctgtgtgttaca

SEQ ID NO: 971241 - DNA, 25 bp, Mus musculus
tttctgtttggaatgggctaactat

SEQ ID NO: 971242 - DNA, 25 bp, Mus musculus
tttctgtttggattgggctaactat

SEQ ID NO: 971243 - DNA, 25 bp, Mus musculus
tttctgtttgtaagccctgtggacc

SEQ ID NO: 971244 - DNA, 25 bp, Mus musculus
tttctgtttgtatgccctgtggacc

SEQ ID NO: 971245 - DNA, 25 bp, Mus musculus
tttctgttttcccttggagtactgg

SEQ ID NO: 971246 - DNA, 25 bp, Mus musculus
tttctgttttccgttggagtactgg

SEQ ID NO: 971247 - DNA, 25 bp, Mus musculus
tttctgttttctagggcaggaatga

SEQ ID NO: 971248 - DNA, 25 bp, Mus musculus
tttctgttttcttgggcaggaatga

SEQ ID NO: 971249 - DNA, 25 bp, Mus musculus
tttctgtttttgacaattatccttg

SEQ ID NO: 971250 - DNA, 25 bp, Mus musculus
tttctgtttttgtcaattatccttg

SEQ ID NO: 971251 - DNA, 25 bp, Mus musculus
tttcttaaaatgactgtcaggtctg

SEQ ID NO: 971252 - DNA, 25 bp, Mus musculus
tttcttaaaatgtctgtcaggtctg

SEQ ID NO: 971253 - DNA, 25 bp, Mus musculus
tttcttaaactcctttgaagaccat

SEQ ID NO: 971254 - DNA, 25 bp, Mus musculus
tttcttaaactcgtttgaagaccat

SEQ ID NO: 971255 - DNA, 25 bp, Mus musculus
tttcttaaagcaaaacttttcctgc

SEQ ID NO: 971256 - DNA, 25 bp, Mus musculus
tttcttaaagcataacttttcctgc

SEQ ID NO: 971257 - DNA, 25 bp, Mus musculus
tttcttaaatgtcagcctccggtag

SEQ ID NO: 971258 - DNA, 25 bp, Mus musculus
tttcttaaatgtgagcctccggtag

SEQ ID NO: 971259 - DNA, 25 bp, Mus musculus
tttcttaacttaaactacccctgat

SEQ ID NO: 971260 - DNA, 25 bp, Mus musculus
tttcttaacttatactacccctgat

SEQ ID NO: 971261 - DNA, 25 bp, Mus musculus
tttcttaatcttcccacttactgtc

SEQ ID NO: 971262 - DNA, 25 bp, Mus musculus
tttcttaatcttgccacttactgtc

SEQ ID NO: 971263 - DNA, 25 bp, Mus musculus
tttcttaattttctgctctaacgac

SEQ ID NO: 971264 - DNA, 25 bp, Mus musculus
tttcttaattttgtgctctaacgac

SEQ ID NO: 971265 - DNA, 25 bp, Mus musculus
tttcttacaagcatcttctgatcgt

SEQ ID NO: 971266 - DNA, 25 bp, Mus musculus
tttcttacaagcttcttctgatcgt

SEQ ID NO: 971267 - DNA, 25 bp, Mus musculus
tttcttacaagtcaatccccttctg

SEQ ID NO: 971268 - DNA, 25 bp, Mus musculus
tttcttacaagtgaatccccttctg

SEQ ID NO: 971269 - DNA, 25 bp, Mus musculus
tttcttacacgtacacaggactcag

SEQ ID NO: 971270 - DNA, 25 bp, Mus musculus
tttcttacacgtacagaggagtgtt

SEQ ID NO: 971271 - DNA, 25 bp, Mus musculus
tttcttacacgttcacaggactcag

SEQ ID NO: 971272 - DNA, 25 bp, Mus musculus
tttcttacacgttcagaggagtgtt

SEQ ID NO: 971273 - DNA, 25 bp, Mus musculus
tttcttacagacattttagtagcag

SEQ ID NO: 971274 - DNA, 25 bp, Mus musculus
tttcttacagactttttagtagcag

SEQ ID NO: 971275 - DNA, 25 bp, Mus musculus
tttcttacagtcacacagttgccag

SEQ ID NO: 971276 - DNA, 25 bp, Mus musculus
tttcttacagtctcacagttgccag

SEQ ID NO: 971277 - DNA, 25 bp, Mus musculus
tttcttaccaagctgcactgtgttc

SEQ ID NO: 971278 - DNA, 25 bp, Mus musculus
tttcttaccaaggtgcactgtgttc

SEQ ID NO: 971279 - DNA, 25 bp, Mus musculus
tttcttaccataaagatcaggttcc

SEQ ID NO: 971280 - DNA, 25 bp, Mus musculus
tttcttaccatatagatcaggttcc

SEQ ID NO: 971281 - DNA, 25 bp, Mus musculus
tttcttacccctactgagtaggact

SEQ ID NO: 971282 - DNA, 25 bp, Mus musculus
tttcttaccccttctgagtaggact

SEQ ID NO: 971283 - DNA, 25 bp, Mus musculus
tttcttacccttaatggcattcctc

SEQ ID NO: 971284 - DNA, 25 bp, Mus musculus
tttcttacccttagtctgttcaaat

SEQ ID NO: 971285 - DNA, 25 bp, Mus musculus
tttcttaccctttatggcattcctc

SEQ ID NO: 971286 - DNA, 25 bp, Mus musculus
tttcttaccctttgtctgttcaaat

SEQ ID NO: 971287 - DNA, 25 bp, Mus musculus
tttcttaccgaaatggcaccctctt

SEQ ID NO: 971288 - DNA, 25 bp, Mus musculus
tttcttaccgaattggcaccctctt

SEQ ID NO: 971289 - DNA, 25 bp, Mus musculus
tttcttaccgtactattttgtggag

SEQ ID NO: 971290 - DNA, 25 bp, Mus musculus
tttcttaccgtagtattttgtggag

SEQ ID NO: 971291 - DNA, 25 bp, Mus musculus
tttcttactgctatcaaaatcccaa

SEQ ID NO: 971292 - DNA, 25 bp, Mus musculus
tttcttactgctttcaaaatcccaa

SEQ ID NO: 971293 - DNA, 25 bp, Mus musculus
tttcttactggcaagagttcttggt

SEQ ID NO: 971294 - DNA, 25 bp, Mus musculus
tttcttactggcacagtaggtacct

SEQ ID NO: 971295 - DNA, 25 bp, Mus musculus
tttcttactggctagagttcttggt

SEQ ID NO: 971296 - DNA, 25 bp, Mus musculus
tttcttactggctcagtaggtacct

SEQ ID NO: 971297 - DNA, 25 bp, Mus musculus
tttcttactgtaaagctctccataa

SEQ ID NO: 971298 - DNA, 25 bp, Mus musculus
tttcttactgtatagctctccataa

SEQ ID NO: 971299 - DNA, 25 bp, Mus musculus
tttcttacttatattcttattgaca

SEQ ID NO: 971300 - DNA, 25 bp, Mus musculus
tttcttacttattttcttattgaca

SEQ ID NO: 971301 - DNA, 25 bp, Mus musculus
tttcttacttccataggcactggac

SEQ ID NO: 971302 - DNA, 25 bp, Mus musculus
tttcttacttccttaggcactggac

SEQ ID NO: 971303 - DNA, 25 bp, Mus musculus
tttcttacttcgatacattggtggc

SEQ ID NO: 971304 - DNA, 25 bp, Mus musculus
tttcttacttcgttacattggtggc

SEQ ID NO: 971305 - DNA, 25 bp, Mus musculus
tttcttactttgacatccatgttct

SEQ ID NO: 971306 - DNA, 25 bp, Mus musculus
tttcttactttgtcatccatgttct

SEQ ID NO: 971307 - DNA, 25 bp, Mus musculus
tttcttagaagccataccctgctcc

SEQ ID NO: 971308 - DNA, 25 bp, Mus musculus
tttcttagaagcgataccctgctcc

SEQ ID NO: 971309 - DNA, 25 bp, Mus musculus
tttcttagagagatcacacagcgct

SEQ ID NO: 971310 - DNA, 25 bp, Mus musculus
tttcttagagagttcacacagcgct

SEQ ID NO: 971311 - DNA, 25 bp, Mus musculus
tttcttagatgtacactctctccat

SEQ ID NO: 971312 - DNA, 25 bp, Mus musculus
tttcttagatgttcactctctccat

SEQ ID NO: 971313 - DNA, 25 bp, Mus musculus
tttcttaggccccacagttgttgaa

SEQ ID NO: 971314 - DNA, 25 bp, Mus musculus
tttcttaggcccgacagttgttgaa

SEQ ID NO: 971315 - DNA, 25 bp, Mus musculus
tttcttagggaaccactggccaaag

SEQ ID NO: 971316 - DNA, 25 bp, Mus musculus
tttcttagggaagcactggccaaag

SEQ ID NO: 971317 - DNA, 25 bp, Mus musculus
tttcttagggcaaggtacaacctca

SEQ ID NO: 971318 - DNA, 25 bp, Mus musculus
tttcttagggcatggtacaacctca

SEQ ID NO: 971319 - DNA, 25 bp, Mus musculus
tttcttaggtgaccacagccttgag

SEQ ID NO: 971320 - DNA, 25 bp, Mus musculus
tttcttaggtgagcacagccttgag

SEQ ID NO: 971321 - DNA, 25 bp, Mus musculus
tttcttataagtccagtttcttaaa

SEQ ID NO: 971322 - DNA, 25 bp, Mus musculus
tttcttataagtgcagtttcttaaa

SEQ ID NO: 971323 - DNA, 25 bp, Mus musculus
tttcttatactcctatctcacatca

SEQ ID NO: 971324 - DNA, 25 bp, Mus musculus
tttcttatactcgtatctcacatca

SEQ ID NO: 971325 - DNA, 25 bp, Mus musculus
tttcttatatctactagggtgtgtt

SEQ ID NO: 971326 - DNA, 25 bp, Mus musculus
tttcttatatcttctagggtgtgtt

SEQ ID NO: 971327 - DNA, 25 bp, Mus musculus
tttcttatcagccaacctgtgggac

SEQ ID NO: 971328 - DNA, 25 bp, Mus musculus
tttcttatcagcgaacctgtgggac

SEQ ID NO: 971329 - DNA, 25 bp, Mus musculus
tttcttatcatgctattggctttaa

SEQ ID NO: 971330 - DNA, 25 bp, Mus musculus
tttcttatcatggtattggctttaa

SEQ ID NO: 971331 - DNA, 25 bp, Mus musculus
tttcttatcctactgccccgggatg

SEQ ID NO: 971332 - DNA, 25 bp, Mus musculus
tttcttatcctagtgccccgggatg

SEQ ID NO: 971333 - DNA, 25 bp, Mus musculus
tttcttatctccaaactgtaaaaat

SEQ ID NO: 971334 - DNA, 25 bp, Mus musculus
tttcttatctcctaactgtaaaaat

SEQ ID NO: 971335 - DNA, 25 bp, Mus musculus
tttcttatctttccaatgctcctga

SEQ ID NO: 971336 - DNA, 25 bp, Mus musculus
tttcttatctttgcaatgctcctga

SEQ ID NO: 971337 - DNA, 25 bp, Mus musculus
tttcttatggccacagggatattcc

SEQ ID NO: 971338 - DNA, 25 bp, Mus musculus
tttcttatggcctcagggatattcc

SEQ ID NO: 971339 - DNA, 25 bp, Mus musculus
tttcttatgtgtctttccttaccca

SEQ ID NO: 971340 - DNA, 25 bp, Mus musculus
tttcttatgtgtgtttccttaccca

SEQ ID NO: 971341 - DNA, 25 bp, Mus musculus
tttcttattagcatgccacttcctg

SEQ ID NO: 971342 - DNA, 25 bp, Mus musculus
tttcttattagcttgccacttcctg

SEQ ID NO: 971343 - DNA, 25 bp, Mus musculus
tttcttattgtaaaccctgcagtga

SEQ ID NO: 971344 - DNA, 25 bp, Mus musculus
tttcttattgtataccctgcagtga

SEQ ID NO: 971345 - DNA, 25 bp, Mus musculus
tttcttatttctctacccaatcctt

SEQ ID NO: 971346 - DNA, 25 bp, Mus musculus
tttcttatttctgtacccaatcctt

SEQ ID NO: 971347 - DNA, 25 bp, Mus musculus
tttcttcaagaacattgtgacacct

SEQ ID NO: 971348 - DNA, 25 bp, Mus musculus
tttcttcaagaagattgtgacacct

SEQ ID NO: 971349 - DNA, 25 bp, Mus musculus
tttcttcaagacctgagcctggagc

SEQ ID NO: 971350 - DNA, 25 bp, Mus musculus
tttcttcaagacgtgagcctggagc

SEQ ID NO: 971351 - DNA, 25 bp, Mus musculus
tttcttcaagtgacctgtgcagctg

SEQ ID NO: 971352 - DNA, 25 bp, Mus musculus
tttcttcaagtgtcctgtgcagctg

SEQ ID NO: 971353 - DNA, 25 bp, Mus musculus
tttcttcacacactttctaagtata

SEQ ID NO: 971354 - DNA, 25 bp, Mus musculus
tttcttcacacagtttctaagtata

SEQ ID NO: 971355 - DNA, 25 bp, Mus musculus
tttcttcacatcactccttaaggta

SEQ ID NO: 971356 - DNA, 25 bp, Mus musculus
tttcttcacatctctccttaaggta

SEQ ID NO: 971357 - DNA, 25 bp, Mus musculus
tttcttcacattacacgttccagca

SEQ ID NO: 971358 - DNA, 25 bp, Mus musculus
tttcttcacatttcacgttccagca

SEQ ID NO: 971359 - DNA, 25 bp, Mus musculus
tttcttcaccatcccttaaaccagg

SEQ ID NO: 971360 - DNA, 25 bp, Mus musculus
tttcttcaccatgccttaaaccagg

SEQ ID NO: 971361 - DNA, 25 bp, Mus musculus
tttcttcacccacacttggtagagg

SEQ ID NO: 971362 - DNA, 25 bp, Mus musculus
tttcttcacccagacttggtagagg

SEQ ID NO: 971363 - DNA, 25 bp, Mus musculus
tttcttcaccgcagtcccattttaa

SEQ ID NO: 971364 - DNA, 25 bp, Mus musculus
tttcttcaccgctgtcccattttaa

SEQ ID NO: 971365 - DNA, 25 bp, Mus musculus
tttcttcaccgtatctgtgctggga

SEQ ID NO: 971366 - DNA, 25 bp, Mus musculus
tttcttcaccgtttctgtgctggga

SEQ ID NO: 971367 - DNA, 25 bp, Mus musculus
tttcttcaccttagcagggcgggaa

SEQ ID NO: 971368 - DNA, 25 bp, Mus musculus
tttcttcacctttgcagggcgggaa

SEQ ID NO: 971369 - DNA, 25 bp, Mus musculus
tttcttcacgtgcaagtgccttggg

SEQ ID NO: 971370 - DNA, 25 bp, Mus musculus
tttcttcacgtggaagtgccttggg

SEQ ID NO: 971371 - DNA, 25 bp, Mus musculus
tttcttcagagaataacaggctttg

SEQ ID NO: 971372 - DNA, 25 bp, Mus musculus
tttcttcagagattaacaggctttg

SEQ ID NO: 971373 - DNA, 25 bp, Mus musculus
tttcttcagatcagggcagaaccat

SEQ ID NO: 971374 - DNA, 25 bp, Mus musculus
tttcttcagatctgggcagaaccat

SEQ ID NO: 971375 - DNA, 25 bp, Mus musculus
tttcttcagcaactacaccatgtct

SEQ ID NO: 971376 - DNA, 25 bp, Mus musculus
tttcttcagcaagtacaccatgtct

SEQ ID NO: 971377 - DNA, 25 bp, Mus musculus
tttcttcaggaaactgcatttgagc

SEQ ID NO: 971378 - DNA, 25 bp, Mus musculus
tttcttcaggaatctgcatttgagc

SEQ ID NO: 971379 - DNA, 25 bp, Mus musculus
tttcttcatatgagttggccattct

SEQ ID NO: 971380 - DNA, 25 bp, Mus musculus
tttcttcatatgtgttggccattct

SEQ ID NO: 971381 - DNA, 25 bp, Mus musculus
tttcttcatcaactatgcccaggtg

SEQ ID NO: 971382 - DNA, 25 bp, Mus musculus
tttcttcatcaagtatgcccaggtg

SEQ ID NO: 971383 - DNA, 25 bp, Mus musculus
tttcttcatcgaccctgctgggaaa

SEQ ID NO: 971384 - DNA, 25 bp, Mus musculus
tttcttcatcgagcctgctgggaaa

SEQ ID NO: 971385 - DNA, 25 bp, Mus musculus
tttcttcatttgctccagcttctag

SEQ ID NO: 971386 - DNA, 25 bp, Mus musculus
tttcttcatttggtccagcttctag

SEQ ID NO: 971387 - DNA, 25 bp, Mus musculus
tttcttcattttccacatttttgag

SEQ ID NO: 971388 - DNA, 25 bp, Mus musculus
tttcttcattttgcacatttttgag

SEQ ID NO: 971389 - DNA, 25 bp, Mus musculus
tttcttccaaagctcactctagtgt

SEQ ID NO: 971390 - DNA, 25 bp, Mus musculus
tttcttccaaaggtcactctagtgt

SEQ ID NO: 971391 - DNA, 25 bp, Mus musculus
tttcttccaacacctggacttattt

SEQ ID NO: 971392 - DNA, 25 bp, Mus musculus
tttcttccaacagctggacttattt

SEQ ID NO: 971393 - DNA, 25 bp, Mus musculus
tttcttccaagacttgccccggaag

SEQ ID NO: 971394 - DNA, 25 bp, Mus musculus
tttcttccaagagttgccccggaag

SEQ ID NO: 971395 - DNA, 25 bp, Mus musculus
tttcttccacacagatccaggagca

SEQ ID NO: 971396 - DNA, 25 bp, Mus musculus
tttcttccacactgatccaggagca

SEQ ID NO: 971397 - DNA, 25 bp, Mus musculus
tttcttccacctacttctaactgca

SEQ ID NO: 971398 - DNA, 25 bp, Mus musculus
tttcttccaccttcttctaactgca

SEQ ID NO: 971399 - DNA, 25 bp, Mus musculus
tttcttccacgaatgtcacctccta

SEQ ID NO: 971400 - DNA, 25 bp, Mus musculus
tttcttccacgattgtcacctccta

SEQ ID NO: 971401 - DNA, 25 bp, Mus musculus
tttcttccagccagcctttagggca

SEQ ID NO: 971402 - DNA, 25 bp, Mus musculus
tttcttccagcctgcctttagggca

SEQ ID NO: 971403 - DNA, 25 bp, Mus musculus
tttcttccatagaaagcatcttgct

SEQ ID NO: 971404 - DNA, 25 bp, Mus musculus
tttcttccatagaggtcccagttca

SEQ ID NO: 971405 - DNA, 25 bp, Mus musculus
tttcttccatagtaagcatcttgct

SEQ ID NO: 971406 - DNA, 25 bp, Mus musculus
tttcttccatagtggtcccagttca

SEQ ID NO: 971407 - DNA, 25 bp, Mus musculus
tttcttccatccacagcatatgctg

SEQ ID NO: 971408 - DNA, 25 bp, Mus musculus
tttcttccatcctcagcatatgctg

SEQ ID NO: 971409 - DNA, 25 bp, Mus musculus
tttcttccatgcctatgaggaacct

SEQ ID NO: 971410 - DNA, 25 bp, Mus musculus
tttcttccatgcgtatgaggaacct

SEQ ID NO: 971411 - DNA, 25 bp, Mus musculus
tttcttcccaaactgacctcaggga

SEQ ID NO: 971412 - DNA, 25 bp, Mus musculus
tttcttcccaaagtgacctcaggga

SEQ ID NO: 971413 - DNA, 25 bp, Mus musculus
tttcttcccaccaaaatcagtactt

SEQ ID NO: 971414 - DNA, 25 bp, Mus musculus
tttcttcccacctaaatcagtactt

SEQ ID NO: 971415 - DNA, 25 bp, Mus musculus
tttcttcccaggagactttggattc

SEQ ID NO: 971416 - DNA, 25 bp, Mus musculus
tttcttcccaggtgactttggattc

SEQ ID NO: 971417 - DNA, 25 bp, Mus musculus
tttcttcccattattactgtgtcgg

SEQ ID NO: 971418 - DNA, 25 bp, Mus musculus
tttcttcccatttttactgtgtcgg

SEQ ID NO: 971419 - DNA, 25 bp, Mus musculus
tttcttccccaaacttgccaagaga

SEQ ID NO: 971420 - DNA, 25 bp, Mus musculus
tttcttccccaatcttgccaagaga

SEQ ID NO: 971421 - DNA, 25 bp, Mus musculus
tttcttccccatcggccagggatga

SEQ ID NO: 971422 - DNA, 25 bp, Mus musculus
tttcttccccatgggccagggatga

SEQ ID NO: 971423 - DNA, 25 bp, Mus musculus
tttcttccctgtctggaaccatctc

SEQ ID NO: 971424 - DNA, 25 bp, Mus musculus
tttcttccctgtgtggaaccatctc

SEQ ID NO: 971425 - DNA, 25 bp, Mus musculus
tttcttccctttcctgtgtaagatg

SEQ ID NO: 971426 - DNA, 25 bp, Mus musculus
tttcttccctttgctgtgtaagatg

SEQ ID NO: 971427 - DNA, 25 bp, Mus musculus
tttcttccgactactcaagcgtact

SEQ ID NO: 971428 - DNA, 25 bp, Mus musculus
tttcttccgacttctcaagcgtact

SEQ ID NO: 971429 - DNA, 25 bp, Mus musculus
tttcttccgctcattgacagagtat

SEQ ID NO: 971430 - DNA, 25 bp, Mus musculus
tttcttccgctctttgacagagtat

SEQ ID NO: 971431 - DNA, 25 bp, Mus musculus
tttcttccggtgacctctgcgtttg

SEQ ID NO: 971432 - DNA, 25 bp, Mus musculus
tttcttccggtgctgggtgttgaac

SEQ ID NO: 971433 - DNA, 25 bp, Mus musculus
tttcttccggtggtgggtgttgaac

SEQ ID NO: 971434 - DNA, 25 bp, Mus musculus
tttcttccggtgtcctctgcgtttg

SEQ ID NO: 971435 - DNA, 25 bp, Mus musculus
tttcttccgtggctcttttgaacta

SEQ ID NO: 971436 - DNA, 25 bp, Mus musculus
tttcttccgtgggtcttttgaacta

SEQ ID NO: 971437 - DNA, 25 bp, Mus musculus
tttcttcctattaccagtccctgga

SEQ ID NO: 971438 - DNA, 25 bp, Mus musculus
tttcttcctatttccagtccctgga

SEQ ID NO: 971439 - DNA, 25 bp, Mus musculus
tttcttcctcagatgacatttcctt

SEQ ID NO: 971440 - DNA, 25 bp, Mus musculus
tttcttcctcagttgacatttcctt

SEQ ID NO: 971441 - DNA, 25 bp, Mus musculus
tttcttcctcggagttcgtgcagca

SEQ ID NO: 971442 - DNA, 25 bp, Mus musculus
tttcttcctcggtgttcgtgcagca

SEQ ID NO: 971443 - DNA, 25 bp, Mus musculus
tttcttcctcgtattataaatgact

SEQ ID NO: 971444 - DNA, 25 bp, Mus musculus
tttcttcctcgttttataaatgact

SEQ ID NO: 971445 - DNA, 25 bp, Mus musculus
tttcttcctgagacacagattccag

SEQ ID NO: 971446 - DNA, 25 bp, Mus musculus
tttcttcctgagtcacagattccag

SEQ ID NO: 971447 - DNA, 25 bp, Mus musculus
tttcttcctggtagggcctgcacag

SEQ ID NO: 971448 - DNA, 25 bp, Mus musculus
tttcttcctggttgggcctgcacag

SEQ ID NO: 971449 - DNA, 25 bp, Mus musculus
tttcttcctgttcttctgaactgga

SEQ ID NO: 971450 - DNA, 25 bp, Mus musculus
tttcttcctgttgttctgaactgga

SEQ ID NO: 971451 - DNA, 25 bp, Mus musculus
tttcttccttctcctggaatgctga

SEQ ID NO: 971452 - DNA, 25 bp, Mus musculus
tttcttccttctgctggaatgctga

SEQ ID NO: 971453 - DNA, 25 bp, Mus musculus
tttcttcgaaagagccagttactgg

SEQ ID NO: 971454 - DNA, 25 bp, Mus musculus
tttcttcgaaagtgccagttactgg

SEQ ID NO: 971455 - DNA, 25 bp, Mus musculus
tttcttcgatataccggggcactgg

SEQ ID NO: 971456 - DNA, 25 bp, Mus musculus
tttcttcgatattccggggcactgg

SEQ ID NO: 971457 - DNA, 25 bp, Mus musculus
tttcttcggctgatggaaccttgaa

SEQ ID NO: 971458 - DNA, 25 bp, Mus musculus
tttcttcggctgttggaaccttgaa

SEQ ID NO: 971459 - DNA, 25 bp, Mus musculus
tttcttcggcttctttacagttaat

SEQ ID NO: 971460 - DNA, 25 bp, Mus musculus
tttcttcggcttgtttacagttaat

SEQ ID NO: 971461 - DNA, 25 bp, Mus musculus
tttcttcggtatattagtcacaagg

SEQ ID NO: 971462 - DNA, 25 bp, Mus musculus
tttcttcggtattttagtcacaagg

SEQ ID NO: 971463 - DNA, 25 bp, Mus musculus
tttcttcggtgtatggcacgagcac

SEQ ID NO: 971464 - DNA, 25 bp, Mus musculus
tttcttcggtgtttggcacgagcac

SEQ ID NO: 971465 - DNA, 25 bp, Mus musculus
tttcttcgtctgcaggatcgatggt

SEQ ID NO: 971466 - DNA, 25 bp, Mus musculus
tttcttcgtctggaggatcgatggt

SEQ ID NO: 971467 - DNA, 25 bp, Mus musculus
tttcttcgtgctagccagtgatctc

SEQ ID NO: 971468 - DNA, 25 bp, Mus musculus
tttcttcgtgcttgccagtgatctc

SEQ ID NO: 971469 - DNA, 25 bp, Mus musculus
tttcttcgtggtatccccatcacct

SEQ ID NO: 971470 - DNA, 25 bp, Mus musculus
tttcttcgtggtttccccatcacct

SEQ ID NO: 971471 - DNA, 25 bp, Mus musculus
tttcttctaataatcttctgtgagg

SEQ ID NO: 971472 - DNA, 25 bp, Mus musculus
tttcttctaatattcttctgtgagg

SEQ ID NO: 971473 - DNA, 25 bp, Mus musculus
tttcttctacaaacaggactacctg

SEQ ID NO: 971474 - DNA, 25 bp, Mus musculus
tttcttctacaatcaggactacctg

SEQ ID NO: 971475 - DNA, 25 bp, Mus musculus
tttcttctacttacactgtactcag

SEQ ID NO: 971476 - DNA, 25 bp, Mus musculus
tttcttctactttcactgtactcag

SEQ ID NO: 971477 - DNA, 25 bp, Mus musculus
tttcttctagacctggagcaccgtg

SEQ ID NO: 971478 - DNA, 25 bp, Mus musculus
tttcttctagacgtggagcaccgtg

SEQ ID NO: 971479 - DNA, 25 bp, Mus musculus
tttcttctatggcatccctgagttc

SEQ ID NO: 971480 - DNA, 25 bp, Mus musculus
tttcttctatgggatccctgagttc

SEQ ID NO: 971481 - DNA, 25 bp, Mus musculus
tttcttctattgatacgcaggattt

SEQ ID NO: 971482 - DNA, 25 bp, Mus musculus
tttcttctattgttacgcaggattt

SEQ ID NO: 971483 - DNA, 25 bp, Mus musculus
tttcttctcaaaaattgggcagatt

SEQ ID NO: 971484 - DNA, 25 bp, Mus musculus
tttcttctcaaatattgggcagatt

SEQ ID NO: 971485 - DNA, 25 bp, Mus musculus
tttcttctcactattgatgtaaggg

SEQ ID NO: 971486 - DNA, 25 bp, Mus musculus
tttcttctcacttttgatgtaaggg

SEQ ID NO: 971487 - DNA, 25 bp, Mus musculus
tttcttctcattctcattcatcgga

SEQ ID NO: 971488 - DNA, 25 bp, Mus musculus
tttcttctcattgtcattcatcgga

SEQ ID NO: 971489 - DNA, 25 bp, Mus musculus
tttcttctccatctgtcggctaaaa

SEQ ID NO: 971490 - DNA, 25 bp, Mus musculus
tttcttctccatgtgtcggctaaaa

SEQ ID NO: 971491 - DNA, 25 bp, Mus musculus
tttcttctcccgaaactaagtggca

SEQ ID NO: 971492 - DNA, 25 bp, Mus musculus
tttcttctcccgtaactaagtggca

SEQ ID NO: 971493 - DNA, 25 bp, Mus musculus
tttcttctcctacttctcttttaag

SEQ ID NO: 971494 - DNA, 25 bp, Mus musculus
tttcttctcctacttgtccaatagc

SEQ ID NO: 971495 - DNA, 25 bp, Mus musculus
tttcttctcctagttctcttttaag

SEQ ID NO: 971496 - DNA, 25 bp, Mus musculus
tttcttctcctagttgtccaatagc

SEQ ID NO: 971497 - DNA, 25 bp, Mus musculus
tttcttctcctcctgattcaatgga

SEQ ID NO: 971498 - DNA, 25 bp, Mus musculus
tttcttctcctcgtgattcaatgga

SEQ ID NO: 971499 - DNA, 25 bp, Mus musculus
tttcttctccttcggcgttcctggg

SEQ ID NO: 971500 - DNA, 25 bp, Mus musculus
tttcttctccttgggcgttcctggg

SEQ ID NO: 971501 - DNA, 25 bp, Mus musculus
tttcttctctataatccaggccaat

SEQ ID NO: 971502 - DNA, 25 bp, Mus musculus
tttcttctctattatccaggccaat

SEQ ID NO: 971503 - DNA, 25 bp, Mus musculus
tttcttctctcccacacaaagtatc

SEQ ID NO: 971504 - DNA, 25 bp, Mus musculus
tttcttctctccgacacaaagtatc

SEQ ID NO: 971505 - DNA, 25 bp, Mus musculus
tttcttctctctatatcatagccct

SEQ ID NO: 971506 - DNA, 25 bp, Mus musculus
tttcttctctctttatcatagccct

SEQ ID NO: 971507 - DNA, 25 bp, Mus musculus
tttcttctctgcagtctacacataa

SEQ ID NO: 971508 - DNA, 25 bp, Mus musculus
tttcttctctgctgtctacacataa

SEQ ID NO: 971509 - DNA, 25 bp, Mus musculus
tttcttctctggacaagcatccaac

SEQ ID NO: 971510 - DNA, 25 bp, Mus musculus
tttcttctctggcagctgcaaacag

SEQ ID NO: 971511 - DNA, 25 bp, Mus musculus
tttcttctctggcagttgcagcaga

SEQ ID NO: 971512 - DNA, 25 bp, Mus musculus
tttcttctctgggagctgcaaacag

SEQ ID NO: 971513 - DNA, 25 bp, Mus musculus
tttcttctctgggagttgcagcaga

SEQ ID NO: 971514 - DNA, 25 bp, Mus musculus
tttcttctctggtcaagcatccaac

SEQ ID NO: 971515 - DNA, 25 bp, Mus musculus
tttcttctctgtatagcttctagct

SEQ ID NO: 971516 - DNA, 25 bp, Mus musculus
tttcttctctgtttagcttctagct

SEQ ID NO: 971517 - DNA, 25 bp, Mus musculus
tttcttctcttgaacaatactctga

SEQ ID NO: 971518 - DNA, 25 bp, Mus musculus
tttcttctcttgaactattgtagtt

SEQ ID NO: 971519 - DNA, 25 bp, Mus musculus
tttcttctcttgtacaatactctga

SEQ ID NO: 971520 - DNA, 25 bp, Mus musculus
tttcttctcttgtactattgtagtt

SEQ ID NO: 971521 - DNA, 25 bp, Mus musculus
tttcttctctttacaccaaacaggg

SEQ ID NO: 971522 - DNA, 25 bp, Mus musculus
tttcttctcttttcaccaaacaggg

SEQ ID NO: 971523 - DNA, 25 bp, Mus musculus
tttcttctgagcaccttactgattg

SEQ ID NO: 971524 - DNA, 25 bp, Mus musculus
tttcttctgagctccttactgattg

SEQ ID NO: 971525 - DNA, 25 bp, Mus musculus
tttcttctgattactacctgatcat

SEQ ID NO: 971526 - DNA, 25 bp, Mus musculus
tttcttctgatttctacctgatcat

SEQ ID NO: 971527 - DNA, 25 bp, Mus musculus
tttcttctgcataactctcagctca

SEQ ID NO: 971528 - DNA, 25 bp, Mus musculus
tttcttctgcattactctcagctca

SEQ ID NO: 971529 - DNA, 25 bp, Mus musculus
tttcttctgcctaatcctctttgga

SEQ ID NO: 971530 - DNA, 25 bp, Mus musculus
tttcttctgcctcggacctacaact

SEQ ID NO: 971531 - DNA, 25 bp, Mus musculus
tttcttctgcctgggacctacaact

SEQ ID NO: 971532 - DNA, 25 bp, Mus musculus
tttcttctgccttatcctctttgga

SEQ ID NO: 971533 - DNA, 25 bp, Mus musculus
tttcttctgctgctttgatgctaag

SEQ ID NO: 971534 - DNA, 25 bp, Mus musculus
tttcttctgctggtttgatgctaag

SEQ ID NO: 971535 - DNA, 25 bp, Mus musculus
tttcttctggagcttggcatcgtca

SEQ ID NO: 971536 - DNA, 25 bp, Mus musculus
tttcttctggaggttggcatcgtca

SEQ ID NO: 971537 - DNA, 25 bp, Mus musculus
tttcttctggttcaaagcttccacg

SEQ ID NO: 971538 - DNA, 25 bp, Mus musculus
tttcttctggttgaaagcttccacg

SEQ ID NO: 971539 - DNA, 25 bp, Mus musculus
tttcttctgtgtccgtggtgagtat

SEQ ID NO: 971540 - DNA, 25 bp, Mus musculus
tttcttctgtgtgcgtggtgagtat

SEQ ID NO: 971541 - DNA, 25 bp, Mus musculus
tttcttctgttgacagttagccagt

SEQ ID NO: 971542 - DNA, 25 bp, Mus musculus
tttcttctgttgtcagttagccagt

SEQ ID NO: 971543 - DNA, 25 bp, Mus musculus
tttcttcttaatccagccttccaaa

SEQ ID NO: 971544 - DNA, 25 bp, Mus musculus
tttcttcttaatgcagccttccaaa

SEQ ID NO: 971545 - DNA, 25 bp, Mus musculus
tttcttcttcaaacctcccatagaa

SEQ ID NO: 971546 - DNA, 25 bp, Mus musculus
tttcttcttcaatcctcccatagaa

SEQ ID NO: 971547 - DNA, 25 bp, Mus musculus
tttcttcttcatctccattggacaa

SEQ ID NO: 971548 - DNA, 25 bp, Mus musculus
tttcttcttcatgtccattggacaa

SEQ ID NO: 971549 - DNA, 25 bp, Mus musculus
tttcttcttccaaggactaagtcca

SEQ ID NO: 971550 - DNA, 25 bp, Mus musculus
tttcttcttccatggactaagtcca

SEQ ID NO: 971551 - DNA, 25 bp, Mus musculus
tttcttcttcctagacatggtcagt

SEQ ID NO: 971552 - DNA, 25 bp, Mus musculus
tttcttcttccttgacatggtcagt

SEQ ID NO: 971553 - DNA, 25 bp, Mus musculus
tttcttcttgaaagttgccagatgt

SEQ ID NO: 971554 - DNA, 25 bp, Mus musculus
tttcttcttgaatgttgccagatgt

SEQ ID NO: 971555 - DNA, 25 bp, Mus musculus
tttcttcttgatagtcttcccagga

SEQ ID NO: 971556 - DNA, 25 bp, Mus musculus
tttcttcttgattgtcttcccagga

SEQ ID NO: 971557 - DNA, 25 bp, Mus musculus
tttcttcttggtcccatactggaaa

SEQ ID NO: 971558 - DNA, 25 bp, Mus musculus
tttcttcttggtgccatactggaaa

SEQ ID NO: 971559 - DNA, 25 bp, Mus musculus
tttcttctttaaccaaccactccgg

SEQ ID NO: 971560 - DNA, 25 bp, Mus musculus
tttcttctttaagcaaccactccgg

SEQ ID NO: 971561 - DNA, 25 bp, Mus musculus
tttcttctttataaaatgagcacac

SEQ ID NO: 971562 - DNA, 25 bp, Mus musculus
tttcttctttatcaactatccttcc

SEQ ID NO: 971563 - DNA, 25 bp, Mus musculus
tttcttctttatgaactatccttcc

SEQ ID NO: 971564 - DNA, 25 bp, Mus musculus
tttcttctttattaaatgagcacac

SEQ ID NO: 971565 - DNA, 25 bp, Mus musculus
tttcttctttgcacagttggtaata

SEQ ID NO: 971566 - DNA, 25 bp, Mus musculus
tttcttctttgctcagttggtaata

SEQ ID NO: 971567 - DNA, 25 bp, Mus musculus
tttcttcttttaatcctccttgatt

SEQ ID NO: 971568 - DNA, 25 bp, Mus musculus
tttcttcttttattcctccttgatt

SEQ ID NO: 971569 - DNA, 25 bp, Mus musculus
tttcttctttttcgtcatgcagctt

SEQ ID NO: 971570 - DNA, 25 bp, Mus musculus
tttcttctttttggtcatgcagctt

SEQ ID NO: 971571 - DNA, 25 bp, Mus musculus
tttcttgaaaatcccctggtaattt

SEQ ID NO: 971572 - DNA, 25 bp, Mus musculus
tttcttgaaaatgccctggtaattt

SEQ ID NO: 971573 - DNA, 25 bp, Mus musculus
tttcttgaacataaggccagtttac

SEQ ID NO: 971574 - DNA, 25 bp, Mus musculus
tttcttgaacattaggccagtttac

SEQ ID NO: 971575 - DNA, 25 bp, Mus musculus
tttcttgaagccatagagtcacccc

SEQ ID NO: 971576 - DNA, 25 bp, Mus musculus
tttcttgaagccttagagtcacccc

SEQ ID NO: 971577 - DNA, 25 bp, Mus musculus
tttcttgaagtcaaactctgtgcta

SEQ ID NO: 971578 - DNA, 25 bp, Mus musculus
tttcttgaagtctaactctgtgcta

SEQ ID NO: 971579 - DNA, 25 bp, Mus musculus
tttcttgacaaacacatgccccagt

SEQ ID NO: 971580 - DNA, 25 bp, Mus musculus
tttcttgacaaagacatgccccagt

SEQ ID NO: 971581 - DNA, 25 bp, Mus musculus
tttcttgacagcagacttggcactt

SEQ ID NO: 971582 - DNA, 25 bp, Mus musculus
tttcttgacagctgacttggcactt

SEQ ID NO: 971583 - DNA, 25 bp, Mus musculus
tttcttgaccagagtgccctggttt

SEQ ID NO: 971584 - DNA, 25 bp, Mus musculus
tttcttgaccagtgtgccctggttt

SEQ ID NO: 971585 - DNA, 25 bp, Mus musculus
tttcttgaccatccagacaaagctg

SEQ ID NO: 971586 - DNA, 25 bp, Mus musculus
tttcttgaccatgcagacaaagctg

SEQ ID NO: 971587 - DNA, 25 bp, Mus musculus
tttcttgactctatgggaactctga

SEQ ID NO: 971588 - DNA, 25 bp, Mus musculus
tttcttgactctcaggaattttttc

SEQ ID NO: 971589 - DNA, 25 bp, Mus musculus
tttcttgactctgaggaattttttc

SEQ ID NO: 971590 - DNA, 25 bp, Mus musculus
tttcttgactctttgggaactctga

SEQ ID NO: 971591 - DNA, 25 bp, Mus musculus
tttcttgaggcacgcttctggtttt

SEQ ID NO: 971592 - DNA, 25 bp, Mus musculus
tttcttgaggcaggcttctggtttt

SEQ ID NO: 971593 - DNA, 25 bp, Mus musculus
tttcttgatttgaatcctgctgcaa

SEQ ID NO: 971594 - DNA, 25 bp, Mus musculus
tttcttgatttgtatcctgctgcaa

SEQ ID NO: 971595 - DNA, 25 bp, Mus musculus
tttcttgcaaacagagggtttctga

SEQ ID NO: 971596 - DNA, 25 bp, Mus musculus
tttcttgcaaactgagggtttctga

SEQ ID NO: 971597 - DNA, 25 bp, Mus musculus
tttcttgcaattacagccccattgt

SEQ ID NO: 971598 - DNA, 25 bp, Mus musculus
tttcttgcaatttcagccccattgt

SEQ ID NO: 971599 - DNA, 25 bp, Mus musculus
tttcttgcaggtagcatccacaacg

SEQ ID NO: 971600 - DNA, 25 bp, Mus musculus
tttcttgcaggttgcatccacaacg

SEQ ID NO: 971601 - DNA, 25 bp, Mus musculus
tttcttgccaatatctcttgtagcc

SEQ ID NO: 971602 - DNA, 25 bp, Mus musculus
tttcttgccaatttctcttgtagcc

SEQ ID NO: 971603 - DNA, 25 bp, Mus musculus
tttcttgccatcataggccaaagag

SEQ ID NO: 971604 - DNA, 25 bp, Mus musculus
tttcttgccatcttaggccaaagag

SEQ ID NO: 971605 - DNA, 25 bp, Mus musculus
tttcttgccattacagctaacatag

SEQ ID NO: 971606 - DNA, 25 bp, Mus musculus
tttcttgccatttcagctaacatag

SEQ ID NO: 971607 - DNA, 25 bp, Mus musculus
tttcttgcccatattggtaccaatg

SEQ ID NO: 971608 - DNA, 25 bp, Mus musculus
tttcttgcccattttggtaccaatg

SEQ ID NO: 971609 - DNA, 25 bp, Mus musculus
tttcttgcccttactcattctgaag

SEQ ID NO: 971610 - DNA, 25 bp, Mus musculus
tttcttgccctttctcattctgaag

SEQ ID NO: 971611 - DNA, 25 bp, Mus musculus
tttcttgccgctcatgtgtagtcca

SEQ ID NO: 971612 - DNA, 25 bp, Mus musculus
tttcttgccgctgatgtgtagtcca

SEQ ID NO: 971613 - DNA, 25 bp, Mus musculus
tttcttgcctcaagcacattctggg

SEQ ID NO: 971614 - DNA, 25 bp, Mus musculus
tttcttgcctcatgcacattctggg

SEQ ID NO: 971615 - DNA, 25 bp, Mus musculus
tttcttgctacaaccccttaaaagt

SEQ ID NO: 971616 - DNA, 25 bp, Mus musculus
tttcttgctacatccccttaaaagt

SEQ ID NO: 971617 - DNA, 25 bp, Mus musculus
tttcttgctgctcccctgttgcctg

SEQ ID NO: 971618 - DNA, 25 bp, Mus musculus
tttcttgctgctgccctgttgcctg

SEQ ID NO: 971619 - DNA, 25 bp, Mus musculus
tttcttgctgtgatatcattcctta

SEQ ID NO: 971620 - DNA, 25 bp, Mus musculus
tttcttgctgtgttatcattcctta

SEQ ID NO: 971621 - DNA, 25 bp, Mus musculus
tttcttgctgttcatggtgaactga

SEQ ID NO: 971622 - DNA, 25 bp, Mus musculus
tttcttgctgttgatggtgaactga

SEQ ID NO: 971623 - DNA, 25 bp, Mus musculus
tttcttgcttacctgactgttgatg

SEQ ID NO: 971624 - DNA, 25 bp, Mus musculus
tttcttgcttacgtgactgttgatg

SEQ ID NO: 971625 - DNA, 25 bp, Mus musculus
tttcttgcttatattggtgcgagga

SEQ ID NO: 971626 - DNA, 25 bp, Mus musculus
tttcttgcttattttggtgcgagga

SEQ ID NO: 971627 - DNA, 25 bp, Mus musculus
tttcttgctttaatgcttccaggac

SEQ ID NO: 971628 - DNA, 25 bp, Mus musculus
tttcttgctttattgcttccaggac

SEQ ID NO: 971629 - DNA, 25 bp, Mus musculus
tttcttgctttcctcctcctttact

SEQ ID NO: 971630 - DNA, 25 bp, Mus musculus
tttcttgctttcgtcctcctttact

SEQ ID NO: 971631 - DNA, 25 bp, Mus musculus
tttcttggaagcacagccccgaacc

SEQ ID NO: 971632 - DNA, 25 bp, Mus musculus
tttcttggaagctcagccccgaacc

SEQ ID NO: 971633 - DNA, 25 bp, Mus musculus
tttcttggagttaatctctgtattc

SEQ ID NO: 971634 - DNA, 25 bp, Mus musculus
tttcttggagtttatctctgtattc

SEQ ID NO: 971635 - DNA, 25 bp, Mus musculus
tttcttggatcccaatttttgtggg

SEQ ID NO: 971636 - DNA, 25 bp, Mus musculus
tttcttggatccgaatttttgtggg

SEQ ID NO: 971637 - DNA, 25 bp, Mus musculus
tttcttggctatcaagtctccctgt

SEQ ID NO: 971638 - DNA, 25 bp, Mus musculus
tttcttggctatgaagtctccctgt

SEQ ID NO: 971639 - DNA, 25 bp, Mus musculus
tttcttggctttaagagctttttca

SEQ ID NO: 971640 - DNA, 25 bp, Mus musculus
tttcttggcttttagagctttttca

SEQ ID NO: 971641 - DNA, 25 bp, Mus musculus
tttcttgggaaaacactagcattat

SEQ ID NO: 971642 - DNA, 25 bp, Mus musculus
tttcttgggaaatcactagcattat

SEQ ID NO: 971643 - DNA, 25 bp, Mus musculus
tttcttgggcaaatgatcctctggt

SEQ ID NO: 971644 - DNA, 25 bp, Mus musculus
tttcttgggcaattgatcctctggt

SEQ ID NO: 971645 - DNA, 25 bp, Mus musculus
tttcttgggcttactgcagatttgc

SEQ ID NO: 971646 - DNA, 25 bp, Mus musculus
tttcttgggctttctgcagatttgc

SEQ ID NO: 971647 - DNA, 25 bp, Mus musculus
tttcttggtacgcaagtgtgctcac

SEQ ID NO: 971648 - DNA, 25 bp, Mus musculus
tttcttggtacggaagtgtgctcac

SEQ ID NO: 971649 - DNA, 25 bp, Mus musculus
tttcttggtgacctgccagaatcaa

SEQ ID NO: 971650 - DNA, 25 bp, Mus musculus
tttcttggtgacgtgccagaatcaa

SEQ ID NO: 971651 - DNA, 25 bp, Mus musculus
tttcttggttctacaattgtaatag

SEQ ID NO: 971652 - DNA, 25 bp, Mus musculus
tttcttggttcttcaattgtaatag

SEQ ID NO: 971653 - DNA, 25 bp, Mus musculus
tttcttggttttccagccaccactg

SEQ ID NO: 971654 - DNA, 25 bp, Mus musculus
tttcttggttttgcagccaccactg

SEQ ID NO: 971655 - DNA, 25 bp, Mus musculus
tttcttgtaaagagcttttgaatta

SEQ ID NO: 971656 - DNA, 25 bp, Mus musculus
tttcttgtaaagtgcttttgaatta

SEQ ID NO: 971657 - DNA, 25 bp, Mus musculus
tttcttgtacaacttctgcggaagg

SEQ ID NO: 971658 - DNA, 25 bp, Mus musculus
tttcttgtacaagttctgcggaagg

SEQ ID NO: 971659 - DNA, 25 bp, Mus musculus
tttcttgtcagtagcagagacctgc

SEQ ID NO: 971660 - DNA, 25 bp, Mus musculus
tttcttgtcagttgcagagacctgc

SEQ ID NO: 971661 - DNA, 25 bp, Mus musculus
tttcttgtccggagtttaagcctct

SEQ ID NO: 971662 - DNA, 25 bp, Mus musculus
tttcttgtccggtgtttaagcctct

SEQ ID NO: 971663 - DNA, 25 bp, Mus musculus
tttcttgtcctaaggcttacagctt

SEQ ID NO: 971664 - DNA, 25 bp, Mus musculus
tttcttgtcctatggcttacagctt

SEQ ID NO: 971665 - DNA, 25 bp, Mus musculus
tttcttgtctttagcttcgggccga

SEQ ID NO: 971666 - DNA, 25 bp, Mus musculus
tttcttgtcttttgcttcgggccga

SEQ ID NO: 971667 - DNA, 25 bp, Mus musculus
tttcttgtgacaagtactgacgata

SEQ ID NO: 971668 - DNA, 25 bp, Mus musculus
tttcttgtgacatgtactgacgata

SEQ ID NO: 971669 - DNA, 25 bp, Mus musculus
tttcttgtgctgatctcatgtgagt

SEQ ID NO: 971670 - DNA, 25 bp, Mus musculus
tttcttgtgctgttctcatgtgagt

SEQ ID NO: 971671 - DNA, 25 bp, Mus musculus
tttcttgtggatactgctgtctttt

SEQ ID NO: 971672 - DNA, 25 bp, Mus musculus
tttcttgtggattctgctgtctttt

SEQ ID NO: 971673 - DNA, 25 bp, Mus musculus
tttcttgtgtcgactgttatcttcc

SEQ ID NO: 971674 - DNA, 25 bp, Mus musculus
tttcttgtgtcgtctgttatcttcc

SEQ ID NO: 971675 - DNA, 25 bp, Mus musculus
tttcttgttgtgaccagcagtgttt

SEQ ID NO: 971676 - DNA, 25 bp, Mus musculus
tttcttgttgtgtccagcagtgttt

SEQ ID NO: 971677 - DNA, 25 bp, Mus musculus
tttcttgtttccacagacagggtgg

SEQ ID NO: 971678 - DNA, 25 bp, Mus musculus
tttcttgtttcctcagacagggtgg

SEQ ID NO: 971679 - DNA, 25 bp, Mus musculus
tttcttgtttctcttctagttgtaa

SEQ ID NO: 971680 - DNA, 25 bp, Mus musculus
tttcttgtttctgttctagttgtaa

SEQ ID NO: 971681 - DNA, 25 bp, Mus musculus
tttcttgtttggctactggctttaa

SEQ ID NO: 971682 - DNA, 25 bp, Mus musculus
tttcttgtttgggtactggctttaa

SEQ ID NO: 971683 - DNA, 25 bp, Mus musculus
tttctttaacataccctccaaaatg

SEQ ID NO: 971684 - DNA, 25 bp, Mus musculus
tttctttaacattccctccaaaatg

SEQ ID NO: 971685 - DNA, 25 bp, Mus musculus
tttctttaaccaattcactactgag

SEQ ID NO: 971686 - DNA, 25 bp, Mus musculus
tttctttaaccatttcactactgag

SEQ ID NO: 971687 - DNA, 25 bp, Mus musculus
tttctttaagacagtggtttcccag

SEQ ID NO: 971688 - DNA, 25 bp, Mus musculus
tttctttaagactgtggtttcccag

SEQ ID NO: 971689 - DNA, 25 bp, Mus musculus
tttctttaagtacttactgtcttgc

SEQ ID NO: 971690 - DNA, 25 bp, Mus musculus
tttctttaagtagttactgtcttgc

SEQ ID NO: 971691 - DNA, 25 bp, Mus musculus
tttctttacactcagcaatccttga

SEQ ID NO: 971692 - DNA, 25 bp, Mus musculus
tttctttacactgagcaatccttga

SEQ ID NO: 971693 - DNA, 25 bp, Mus musculus
tttctttacagacactttttcccat

SEQ ID NO: 971694 - DNA, 25 bp, Mus musculus
tttctttacagagactttttcccat

SEQ ID NO: 971695 - DNA, 25 bp, Mus musculus
tttctttaccctactgagctgttta

SEQ ID NO: 971696 - DNA, 25 bp, Mus musculus
tttctttaccctcactcattcctta

SEQ ID NO: 971697 - DNA, 25 bp, Mus musculus
tttctttaccctgactcattcctta

SEQ ID NO: 971698 - DNA, 25 bp, Mus musculus
tttctttacccttctgagctgttta

SEQ ID NO: 971699 - DNA, 25 bp, Mus musculus
tttctttacctgacttggttaccag

SEQ ID NO: 971700 - DNA, 25 bp, Mus musculus
tttctttacctgtcttggttaccag

SEQ ID NO: 971701 - DNA, 25 bp, Mus musculus
tttctttacttcagatgtctgctgc

SEQ ID NO: 971702 - DNA, 25 bp, Mus musculus
tttctttacttctgatgtctgctgc

SEQ ID NO: 971703 - DNA, 25 bp, Mus musculus
tttctttagaaaccggccacctgct

SEQ ID NO: 971704 - DNA, 25 bp, Mus musculus
tttctttagaaagcggccacctgct

SEQ ID NO: 971705 - DNA, 25 bp, Mus musculus
tttctttagactatccaacacctga

SEQ ID NO: 971706 - DNA, 25 bp, Mus musculus
tttctttagactttccaacacctga

SEQ ID NO: 971707 - DNA, 25 bp, Mus musculus
tttctttagaggctgggccaataat

SEQ ID NO: 971708 - DNA, 25 bp, Mus musculus
tttctttagagggtgggccaataat

SEQ ID NO: 971709 - DNA, 25 bp, Mus musculus
tttctttagcccaagattccaggca

SEQ ID NO: 971710 - DNA, 25 bp, Mus musculus
tttctttagccctagattccaggca

SEQ ID NO: 971711 - DNA, 25 bp, Mus musculus
tttctttagctcctccactgtggaa

SEQ ID NO: 971712 - DNA, 25 bp, Mus musculus
tttctttagctcgtccactgtggaa

SEQ ID NO: 971713 - DNA, 25 bp, Mus musculus
tttctttagctgattcaatgagatc

SEQ ID NO: 971714 - DNA, 25 bp, Mus musculus
tttctttagctgtttcaatgagatc

SEQ ID NO: 971715 - DNA, 25 bp, Mus musculus
tttctttagcttagcccagtttcca

SEQ ID NO: 971716 - DNA, 25 bp, Mus musculus
tttctttagctttgcccagtttcca

SEQ ID NO: 971717 - DNA, 25 bp, Mus musculus
tttctttagtctactactccacagt

SEQ ID NO: 971718 - DNA, 25 bp, Mus musculus
tttctttagtcttctactccacagt

SEQ ID NO: 971719 - DNA, 25 bp, Mus musculus
tttctttataaaacgtgctcagcaa

SEQ ID NO: 971720 - DNA, 25 bp, Mus musculus
tttctttataaatcgtgctcagcaa

SEQ ID NO: 971721 - DNA, 25 bp, Mus musculus
tttctttatcttctcctcacaacga

SEQ ID NO: 971722 - DNA, 25 bp, Mus musculus
tttctttatcttgtcctcacaacga

SEQ ID NO: 971723 - DNA, 25 bp, Mus musculus
tttctttatgaaacccaaccaactg

SEQ ID NO: 971724 - DNA, 25 bp, Mus musculus
tttctttatgaatcccaaccaactg

SEQ ID NO: 971725 - DNA, 25 bp, Mus musculus
tttctttatgagcatgaggcatgtg

SEQ ID NO: 971726 - DNA, 25 bp, Mus musculus
tttctttatgaggatgaggcatgtg

SEQ ID NO: 971727 - DNA, 25 bp, Mus musculus
tttctttcaaaccagggtgggcctg

SEQ ID NO: 971728 - DNA, 25 bp, Mus musculus
tttctttcaaacgagggtgggcctg

SEQ ID NO: 971729 - DNA, 25 bp, Mus musculus
tttctttcacagcactgaggtctca

SEQ ID NO: 971730 - DNA, 25 bp, Mus musculus
tttctttcacaggactgaggtctca

SEQ ID NO: 971731 - DNA, 25 bp, Mus musculus
tttctttcacggcacttcaacatat

SEQ ID NO: 971732 - DNA, 25 bp, Mus musculus
tttctttcacgggacttcaacatat

SEQ ID NO: 971733 - DNA, 25 bp, Mus musculus
tttctttcagatagattttcttagt

SEQ ID NO: 971734 - DNA, 25 bp, Mus musculus
tttctttcagattgattttcttagt

SEQ ID NO: 971735 - DNA, 25 bp, Mus musculus
tttctttcattcaagccacaaattg

SEQ ID NO: 971736 - DNA, 25 bp, Mus musculus
tttctttcattctagccacaaattg

SEQ ID NO: 971737 - DNA, 25 bp, Mus musculus
tttctttccaaacacaggttgtggt

SEQ ID NO: 971738 - DNA, 25 bp, Mus musculus
tttctttccaaagacaggttgtggt

SEQ ID NO: 971739 - DNA, 25 bp, Mus musculus
tttctttccaagcttcagagagtgg

SEQ ID NO: 971740 - DNA, 25 bp, Mus musculus
tttctttccaaggttcagagagtgg

SEQ ID NO: 971741 - DNA, 25 bp, Mus musculus
tttctttccaatcacctactctcaa

SEQ ID NO: 971742 - DNA, 25 bp, Mus musculus
tttctttccaatgacctactctcaa

SEQ ID NO: 971743 - DNA, 25 bp, Mus musculus
tttctttccagtaaatgcctttcag

SEQ ID NO: 971744 - DNA, 25 bp, Mus musculus
tttctttccagttaatgcctttcag

SEQ ID NO: 971745 - DNA, 25 bp, Mus musculus
tttctttccatgattggctgttggt

SEQ ID NO: 971746 - DNA, 25 bp, Mus musculus
tttctttccatgtttggctgttggt

SEQ ID NO: 971747 - DNA, 25 bp, Mus musculus
tttctttccattcctctctcactgt

SEQ ID NO: 971748 - DNA, 25 bp, Mus musculus
tttctttccattgctctctcactgt

SEQ ID NO: 971749 - DNA, 25 bp, Mus musculus
tttctttcccgcattcgcttaagat

SEQ ID NO: 971750 - DNA, 25 bp, Mus musculus
tttctttcccgctttcgcttaagat

SEQ ID NO: 971751 - DNA, 25 bp, Mus musculus
tttctttccctacagtctacctgta

SEQ ID NO: 971752 - DNA, 25 bp, Mus musculus
tttctttccctagagtctacctgta

SEQ ID NO: 971753 - DNA, 25 bp, Mus musculus
tttctttccctgcactttgttacat

SEQ ID NO: 971754 - DNA, 25 bp, Mus musculus
tttctttccctggactttgttacat

SEQ ID NO: 971755 - DNA, 25 bp, Mus musculus
tttctttcccttaataatccaccat

SEQ ID NO: 971756 - DNA, 25 bp, Mus musculus
tttctttccctttataatccaccat

SEQ ID NO: 971757 - DNA, 25 bp, Mus musculus
tttctttccggacatagggtgtaat

SEQ ID NO: 971758 - DNA, 25 bp, Mus musculus
tttctttccggagatagggtgtaat

SEQ ID NO: 971759 - DNA, 25 bp, Mus musculus
tttctttcctaaacctgcctagaga

SEQ ID NO: 971760 - DNA, 25 bp, Mus musculus
tttctttcctaatcctgcctagaga

SEQ ID NO: 971761 - DNA, 25 bp, Mus musculus
tttctttcctatccatgggcagagc

SEQ ID NO: 971762 - DNA, 25 bp, Mus musculus
tttctttcctatgcatgggcagagc

SEQ ID NO: 971763 - DNA, 25 bp, Mus musculus
tttctttcctccctcagaagggaga

SEQ ID NO: 971764 - DNA, 25 bp, Mus musculus
tttctttcctccgtcagaagggaga

SEQ ID NO: 971765 - DNA, 25 bp, Mus musculus
tttctttcctgaaataacgtgggag

SEQ ID NO: 971766 - DNA, 25 bp, Mus musculus
tttctttcctgaattgctgatacta

SEQ ID NO: 971767 - DNA, 25 bp, Mus musculus
tttctttcctgaatttgggcagatg

SEQ ID NO: 971768 - DNA, 25 bp, Mus musculus
tttctttcctgatataacgtgggag

SEQ ID NO: 971769 - DNA, 25 bp, Mus musculus
tttctttcctgatttgctgatacta

SEQ ID NO: 971770 - DNA, 25 bp, Mus musculus
tttctttcctgattttgggcagatg

SEQ ID NO: 971771 - DNA, 25 bp, Mus musculus
tttctttcctgtacacaatgttttg

SEQ ID NO: 971772 - DNA, 25 bp, Mus musculus
tttctttcctgttcacaatgttttg

SEQ ID NO: 971773 - DNA, 25 bp, Mus musculus
tttctttccttcagcatttctcttt

SEQ ID NO: 971774 - DNA, 25 bp, Mus musculus
tttctttccttctgcatttctcttt

SEQ ID NO: 971775 - DNA, 25 bp, Mus musculus
tttctttctacccatcagtaagtgg

SEQ ID NO: 971776 - DNA, 25 bp, Mus musculus
tttctttctaccgatcagtaagtgg

SEQ ID NO: 971777 - DNA, 25 bp, Mus musculus
tttctttctactccccaagcacaaa

SEQ ID NO: 971778 - DNA, 25 bp, Mus musculus
tttctttctactgcccaagcacaaa

SEQ ID NO: 971779 - DNA, 25 bp, Mus musculus
tttctttctagtattcccagactgg

SEQ ID NO: 971780 - DNA, 25 bp, Mus musculus
tttctttctagttttcccagactgg

SEQ ID NO: 971781 - DNA, 25 bp, Mus musculus
tttctttctcacatccactgaagag

SEQ ID NO: 971782 - DNA, 25 bp, Mus musculus
tttctttctcacttccactgaagag

SEQ ID NO: 971783 - DNA, 25 bp, Mus musculus
tttctttctccactcagtgcagcac

SEQ ID NO: 971784 - DNA, 25 bp, Mus musculus
tttctttctccagtcagtgcagcac

SEQ ID NO: 971785 - DNA, 25 bp, Mus musculus
tttctttctctacatgaaagcttgc

SEQ ID NO: 971786 - DNA, 25 bp, Mus musculus
tttctttctctagatgaaagcttgc

SEQ ID NO: 971787 - DNA, 25 bp, Mus musculus
tttctttctctccattgacctttgt

SEQ ID NO: 971788 - DNA, 25 bp, Mus musculus
tttctttctctcgattgacctttgt

SEQ ID NO: 971789 - DNA, 25 bp, Mus musculus
tttctttctgccagacataatgcat

SEQ ID NO: 971790 - DNA, 25 bp, Mus musculus
tttctttctgcctgacataatgcat

SEQ ID NO: 971791 - DNA, 25 bp, Mus musculus
tttctttctgtacaagcattcccac

SEQ ID NO: 971792 - DNA, 25 bp, Mus musculus
tttctttctgtagaagcattcccac

SEQ ID NO: 971793 - DNA, 25 bp, Mus musculus
tttctttctgttcctattcttgtgg

SEQ ID NO: 971794 - DNA, 25 bp, Mus musculus
tttctttctgttgctattcttgtgg

SEQ ID NO: 971795 - DNA, 25 bp, Mus musculus
tttctttcttcactttgtctctaat

SEQ ID NO: 971796 - DNA, 25 bp, Mus musculus
tttctttcttcagtttgtctctaat

SEQ ID NO: 971797 - DNA, 25 bp, Mus musculus
tttctttcttcccaagtacactcag

SEQ ID NO: 971798 - DNA, 25 bp, Mus musculus
tttctttcttccgaagtacactcag

SEQ ID NO: 971799 - DNA, 25 bp, Mus musculus
tttctttcttttcaggtgctatggc

SEQ ID NO: 971800 - DNA, 25 bp, Mus musculus
tttctttcttttgaggtgctatggc

SEQ ID NO: 971801 - DNA, 25 bp, Mus musculus
tttctttgacaaaacctaacttgcg

SEQ ID NO: 971802 - DNA, 25 bp, Mus musculus
tttctttgacaatacctaacttgcg

SEQ ID NO: 971803 - DNA, 25 bp, Mus musculus
tttctttgagctagatcctccaagg

SEQ ID NO: 971804 - DNA, 25 bp, Mus musculus
tttctttgagcttgatcctccaagg

SEQ ID NO: 971805 - DNA, 25 bp, Mus musculus
tttctttgagggaccttttgagctc

SEQ ID NO: 971806 - DNA, 25 bp, Mus musculus
tttctttgagggtccttttgagctc

SEQ ID NO: 971807 - DNA, 25 bp, Mus musculus
tttctttgccacattgatgctcgtg

SEQ ID NO: 971808 - DNA, 25 bp, Mus musculus
tttctttgccactttgatgctcgtg

SEQ ID NO: 971809 - DNA, 25 bp, Mus musculus
tttctttgccatattgggctaggga

SEQ ID NO: 971810 - DNA, 25 bp, Mus musculus
tttctttgccattttgggctaggga

SEQ ID NO: 971811 - DNA, 25 bp, Mus musculus
tttctttgcccaacaggtggcacga

SEQ ID NO: 971812 - DNA, 25 bp, Mus musculus
tttctttgcccatcaggtggcacga

SEQ ID NO: 971813 - DNA, 25 bp, Mus musculus
tttctttgccggcatagctgtactt

SEQ ID NO: 971814 - DNA, 25 bp, Mus musculus
tttctttgccgggatagctgtactt

SEQ ID NO: 971815 - DNA, 25 bp, Mus musculus
tttctttgctccactgtatttttag

SEQ ID NO: 971816 - DNA, 25 bp, Mus musculus
tttctttgctcctctgtatttttag

SEQ ID NO: 971817 - DNA, 25 bp, Mus musculus
tttctttgcttgctgaatgaatgcc

SEQ ID NO: 971818 - DNA, 25 bp, Mus musculus
tttctttgcttggtgaatgaatgcc

SEQ ID NO: 971819 - DNA, 25 bp, Mus musculus
tttctttggactatgaagctactgc

SEQ ID NO: 971820 - DNA, 25 bp, Mus musculus
tttctttggactttgaagctactgc

SEQ ID NO: 971821 - DNA, 25 bp, Mus musculus
tttctttggaggcaccttcaaggat

SEQ ID NO: 971822 - DNA, 25 bp, Mus musculus
tttctttggaggctcctagcagggt

SEQ ID NO: 971823 - DNA, 25 bp, Mus musculus
tttctttggagggaccttcaaggat

SEQ ID NO: 971824 - DNA, 25 bp, Mus musculus
tttctttggagggtcctagcagggt

SEQ ID NO: 971825 - DNA, 25 bp, Mus musculus
tttctttggatgactcaggatgcct

SEQ ID NO: 971826 - DNA, 25 bp, Mus musculus
tttctttggatgtctcaggatgcct

SEQ ID NO: 971827 - DNA, 25 bp, Mus musculus
tttctttggattcctttcatttcag

SEQ ID NO: 971828 - DNA, 25 bp, Mus musculus
tttctttggattgctttcatttcag

SEQ ID NO: 971829 - DNA, 25 bp, Mus musculus
tttctttgtcgtcgtgatatttctg

SEQ ID NO: 971830 - DNA, 25 bp, Mus musculus
tttctttgtcgtggtgatatttctg

SEQ ID NO: 971831 - DNA, 25 bp, Mus musculus
tttctttgtcttatgtattctaaat

SEQ ID NO: 971832 - DNA, 25 bp, Mus musculus
tttctttgtcttctgtcagtgacca

SEQ ID NO: 971833 - DNA, 25 bp, Mus musculus
tttctttgtcttgtgtcagtgacca

SEQ ID NO: 971834 - DNA, 25 bp, Mus musculus
tttctttgtcttttgtattctaaat

SEQ ID NO: 971835 - DNA, 25 bp, Mus musculus
tttctttgtgtcaccctaagttctg

SEQ ID NO: 971836 - DNA, 25 bp, Mus musculus
tttctttgtgtctccctaagttctg

SEQ ID NO: 971837 - DNA, 25 bp, Mus musculus
tttctttgttgccaacaactctgta

SEQ ID NO: 971838 - DNA, 25 bp, Mus musculus
tttctttgttgcgaacaactctgta

SEQ ID NO: 971839 - DNA, 25 bp, Mus musculus
tttctttgtttaaactcctctctca

SEQ ID NO: 971840 - DNA, 25 bp, Mus musculus
tttctttgtttatactcctctctca

SEQ ID NO: 971841 - DNA, 25 bp, Mus musculus
tttcttttaaacagggctgtatctt

SEQ ID NO: 971842 - DNA, 25 bp, Mus musculus
tttcttttaaactgggctgtatctt

SEQ ID NO: 971843 - DNA, 25 bp, Mus musculus
tttcttttaagcattgcataattgc

SEQ ID NO: 971844 - DNA, 25 bp, Mus musculus
tttcttttaagctttgcataattgc

SEQ ID NO: 971845 - DNA, 25 bp, Mus musculus
tttcttttacagactcagcaccagc

SEQ ID NO: 971846 - DNA, 25 bp, Mus musculus
tttcttttacagtctcagcaccagc

SEQ ID NO: 971847 - DNA, 25 bp, Mus musculus
tttcttttagctacaatcactttct

SEQ ID NO: 971848 - DNA, 25 bp, Mus musculus
tttcttttagcttcaatcactttct

SEQ ID NO: 971849 - DNA, 25 bp, Mus musculus
tttcttttagtcatcgctagccaga

SEQ ID NO: 971850 - DNA, 25 bp, Mus musculus
tttcttttagtcttcgctagccaga

SEQ ID NO: 971851 - DNA, 25 bp, Mus musculus
tttcttttagtgaactggactcaga

SEQ ID NO: 971852 - DNA, 25 bp, Mus musculus
tttcttttagtgtactggactcaga

SEQ ID NO: 971853 - DNA, 25 bp, Mus musculus
tttcttttagttcccagctgaccaa

SEQ ID NO: 971854 - DNA, 25 bp, Mus musculus
tttcttttagttgccagctgaccaa

SEQ ID NO: 971855 - DNA, 25 bp, Mus musculus
tttcttttcaacatgcatctttata

SEQ ID NO: 971856 - DNA, 25 bp, Mus musculus
tttcttttcaacttgcatctttata

SEQ ID NO: 971857 - DNA, 25 bp, Mus musculus
tttcttttcacacaattgagcccgc

SEQ ID NO: 971858 - DNA, 25 bp, Mus musculus
tttcttttcacacggacaattggat

SEQ ID NO: 971859 - DNA, 25 bp, Mus musculus
tttcttttcacagaattgagcccgc

SEQ ID NO: 971860 - DNA, 25 bp, Mus musculus
tttcttttcacagggacaattggat

SEQ ID NO: 971861 - DNA, 25 bp, Mus musculus
tttcttttcattatgggttccaagg

SEQ ID NO: 971862 - DNA, 25 bp, Mus musculus
tttcttttcattttgggttccaagg

SEQ ID NO: 971863 - DNA, 25 bp, Mus musculus
tttcttttcctgaagacgttctgac

SEQ ID NO: 971864 - DNA, 25 bp, Mus musculus
tttcttttcctgtagacgttctgac

SEQ ID NO: 971865 - DNA, 25 bp, Mus musculus
tttcttttccttaccggatgtgatt

SEQ ID NO: 971866 - DNA, 25 bp, Mus musculus
tttcttttccttcaggtctgtctgt

SEQ ID NO: 971867 - DNA, 25 bp, Mus musculus
tttcttttccttgaggtctgtctgt

SEQ ID NO: 971868 - DNA, 25 bp, Mus musculus
tttcttttcctttccggatgtgatt

SEQ ID NO: 971869 - DNA, 25 bp, Mus musculus
tttcttttctaaatcctcagtaggt

SEQ ID NO: 971870 - DNA, 25 bp, Mus musculus
tttcttttctaattcctcagtaggt

SEQ ID NO: 971871 - DNA, 25 bp, Mus musculus
tttcttttctcgaccacctgagaga

SEQ ID NO: 971872 - DNA, 25 bp, Mus musculus
tttcttttctcgtccacctgagaga

SEQ ID NO: 971873 - DNA, 25 bp, Mus musculus
tttcttttctgacactttcttttct

SEQ ID NO: 971874 - DNA, 25 bp, Mus musculus
tttcttttctgagactttcttttct

SEQ ID NO: 971875 - DNA, 25 bp, Mus musculus
tttcttttctggaggctagagtaac

SEQ ID NO: 971876 - DNA, 25 bp, Mus musculus
tttcttttctggtggctagagtaac

SEQ ID NO: 971877 - DNA, 25 bp, Mus musculus
tttcttttgagacatatgacaaagt

SEQ ID NO: 971878 - DNA, 25 bp, Mus musculus
tttcttttgagagatatgacaaagt

SEQ ID NO: 971879 - DNA, 25 bp, Mus musculus
tttcttttgctcatcctagtggcac

SEQ ID NO: 971880 - DNA, 25 bp, Mus musculus
tttcttttgctcttcctagtggcac

SEQ ID NO: 971881 - DNA, 25 bp, Mus musculus
tttcttttgggacctagggactact

SEQ ID NO: 971882 - DNA, 25 bp, Mus musculus
tttcttttgggagctagggactact

SEQ ID NO: 971883 - DNA, 25 bp, Mus musculus
tttcttttgggccttacctcgtcag

SEQ ID NO: 971884 - DNA, 25 bp, Mus musculus
tttcttttgggcgttacctcgtcag

SEQ ID NO: 971885 - DNA, 25 bp, Mus musculus
tttcttttggtacgtgagtcacact

SEQ ID NO: 971886 - DNA, 25 bp, Mus musculus
tttcttttggtaggtgagtcacact

SEQ ID NO: 971887 - DNA, 25 bp, Mus musculus
tttcttttgtccagagagatcttgt

SEQ ID NO: 971888 - DNA, 25 bp, Mus musculus
tttcttttgtcctgagagatcttgt

SEQ ID NO: 971889 - DNA, 25 bp, Mus musculus
tttcttttgtctagttccccagtga

SEQ ID NO: 971890 - DNA, 25 bp, Mus musculus
tttcttttgtcttgttccccagtga

SEQ ID NO: 971891 - DNA, 25 bp, Mus musculus
tttcttttgtgtcactcttttagcc

SEQ ID NO: 971892 - DNA, 25 bp, Mus musculus
tttcttttgtgtgactcttttagcc

SEQ ID NO: 971893 - DNA, 25 bp, Mus musculus
tttctttttcccaaatgctattgtt

SEQ ID NO: 971894 - DNA, 25 bp, Mus musculus
tttctttttcccagaaatctagaag

SEQ ID NO: 971895 - DNA, 25 bp, Mus musculus
tttctttttccctaatgctattgtt

SEQ ID NO: 971896 - DNA, 25 bp, Mus musculus
tttctttttccctgaaatctagaag

SEQ ID NO: 971897 - DNA, 25 bp, Mus musculus
tttctttttcctatgtctatgtgtt

SEQ ID NO: 971898 - DNA, 25 bp, Mus musculus
tttctttttcctttgtctatgtgtt

SEQ ID NO: 971899 - DNA, 25 bp, Mus musculus
tttctttttcggcaacacaactgaa

SEQ ID NO: 971900 - DNA, 25 bp, Mus musculus
tttctttttcgggaacacaactgaa

SEQ ID NO: 971901 - DNA, 25 bp, Mus musculus
tttctttttctgatctatcttggaa

SEQ ID NO: 971902 - DNA, 25 bp, Mus musculus
tttctttttctgcaatgaatctggc

SEQ ID NO: 971903 - DNA, 25 bp, Mus musculus
tttctttttctggaatgaatctggc

SEQ ID NO: 971904 - DNA, 25 bp, Mus musculus
tttctttttctgttctatcttggaa

SEQ ID NO: 971905 - DNA, 25 bp, Mus musculus
tttctttttgaaatgctggcctgca

SEQ ID NO: 971906 - DNA, 25 bp, Mus musculus
tttctttttgaattgctggcctgca

SEQ ID NO: 971907 - DNA, 25 bp, Mus musculus
tttctttttgacactgtgaccacta

SEQ ID NO: 971908 - DNA, 25 bp, Mus musculus
tttctttttgactctgtgaccacta

SEQ ID NO: 971909 - DNA, 25 bp, Mus musculus
tttcttttttccatatactgcctgc

SEQ ID NO: 971910 - DNA, 25 bp, Mus musculus
tttcttttttccttatactgcctgc

SEQ ID NO: 971911 - DNA, 25 bp, Mus musculus
tttgaaaaactgaatgaccatggtc

SEQ ID NO: 971912 - DNA, 25 bp, Mus musculus
tttgaaaaactgtatgaccatggtc

SEQ ID NO: 971913 - DNA, 25 bp, Mus musculus
tttgaaaacccgagctgcatttttt

SEQ ID NO: 971914 - DNA, 25 bp, Mus musculus
tttgaaaacccgtgctgcatttttt

SEQ ID NO: 971915 - DNA, 25 bp, Mus musculus
tttgaaaactcacgctggctgcttc

SEQ ID NO: 971916 - DNA, 25 bp, Mus musculus
tttgaaaactcaggctggctgcttc

SEQ ID NO: 971917 - DNA, 25 bp, Mus musculus
tttgaaaagactccacggcaccagt

SEQ ID NO: 971918 - DNA, 25 bp, Mus musculus
tttgaaaagactgcacggcaccagt

SEQ ID NO: 971919 - DNA, 25 bp, Mus musculus
tttgaaaaggcccacaacctcaacg

SEQ ID NO: 971920 - DNA, 25 bp, Mus musculus
tttgaaaaggccgacaacctcaacg

SEQ ID NO: 971921 - DNA, 25 bp, Mus musculus
tttgaaaataccagcaaagcctcag

SEQ ID NO: 971922 - DNA, 25 bp, Mus musculus
tttgaaaatacctgcaaagcctcag

SEQ ID NO: 971923 - DNA, 25 bp, Mus musculus
tttgaaaatcagaggttccaggaaa

SEQ ID NO: 971924 - DNA, 25 bp, Mus musculus
tttgaaaatcagtggttccaggaaa

SEQ ID NO: 971925 - DNA, 25 bp, Mus musculus
tttgaaacaactctgcttctttggt

SEQ ID NO: 971926 - DNA, 25 bp, Mus musculus
tttgaaacaactgtgcttctttggt

SEQ ID NO: 971927 - DNA, 25 bp, Mus musculus
tttgaaacaccacctcccacaattt

SEQ ID NO: 971928 - DNA, 25 bp, Mus musculus
tttgaaacaccagctcccacaattt

SEQ ID NO: 971929 - DNA, 25 bp, Mus musculus
tttgaaacactgctcttgccctgtg

SEQ ID NO: 971930 - DNA, 25 bp, Mus musculus
tttgaaacactggtcttgccctgtg

SEQ ID NO: 971931 - DNA, 25 bp, Mus musculus
tttgaaacagcaatgcattcttgac

SEQ ID NO: 971932 - DNA, 25 bp, Mus musculus
tttgaaacagcattgcattcttgac

SEQ ID NO: 971933 - DNA, 25 bp, Mus musculus
tttgaaacaggaaagcaggcccaga

SEQ ID NO: 971934 - DNA, 25 bp, Mus musculus
tttgaaacaggatagcaggcccaga

SEQ ID NO: 971935 - DNA, 25 bp, Mus musculus
tttgaaacaggcagtgatatgcact

SEQ ID NO: 971936 - DNA, 25 bp, Mus musculus
tttgaaacaggctgtgatatgcact

SEQ ID NO: 971937 - DNA, 25 bp, Mus musculus
tttgaaaccaccatgacatcctggg

SEQ ID NO: 971938 - DNA, 25 bp, Mus musculus
tttgaaaccaccttgacatcctggg

SEQ ID NO: 971939 - DNA, 25 bp, Mus musculus
tttgaaaccattcctcccatagtca

SEQ ID NO: 971940 - DNA, 25 bp, Mus musculus
tttgaaaccattgctcccatagtca

SEQ ID NO: 971941 - DNA, 25 bp, Mus musculus
tttgaaactcctagcctctttaatc

SEQ ID NO: 971942 - DNA, 25 bp, Mus musculus
tttgaaactccttgcctctttaatc

SEQ ID NO: 971943 - DNA, 25 bp, Mus musculus
tttgaaagactactaaatgacctgt

SEQ ID NO: 971944 - DNA, 25 bp, Mus musculus
tttgaaagactagtaaatgacctgt

SEQ ID NO: 971945 - DNA, 25 bp, Mus musculus
tttgaaagattcaaggcggcttcct

SEQ ID NO: 971946 - DNA, 25 bp, Mus musculus
tttgaaagattctaggcggcttcct

SEQ ID NO: 971947 - DNA, 25 bp, Mus musculus
tttgaaagcatcacccttagtccag

SEQ ID NO: 971948 - DNA, 25 bp, Mus musculus
tttgaaagcatctcccttagtccag

SEQ ID NO: 971949 - DNA, 25 bp, Mus musculus
tttgaaagcctgagttttctttgct

SEQ ID NO: 971950 - DNA, 25 bp, Mus musculus
tttgaaagcctgtgttttctttgct

SEQ ID NO: 971951 - DNA, 25 bp, Mus musculus
tttgaaaggccaatctgaccattat

SEQ ID NO: 971952 - DNA, 25 bp, Mus musculus
tttgaaaggccattctgaccattat

SEQ ID NO: 971953 - DNA, 25 bp, Mus musculus
tttgaaagtctaacacgtgtttctc

SEQ ID NO: 971954 - DNA, 25 bp, Mus musculus
tttgaaagtctatcacgtgtttctc

SEQ ID NO: 971955 - DNA, 25 bp, Mus musculus
tttgaaagtgatattctgtcagcaa

SEQ ID NO: 971956 - DNA, 25 bp, Mus musculus
tttgaaagtgattttctgtcagcaa

SEQ ID NO: 971957 - DNA, 25 bp, Mus musculus
tttgaaagttcacattaattttact

SEQ ID NO: 971958 - DNA, 25 bp, Mus musculus
tttgaaagttcagattaattttact

SEQ ID NO: 971959 - DNA, 25 bp, Mus musculus
tttgaaagttgaacctcaccactcc

SEQ ID NO: 971960 - DNA, 25 bp, Mus musculus
tttgaaagttgatcctcaccactcc

SEQ ID NO: 971961 - DNA, 25 bp, Mus musculus
tttgaaatagaaaggcatggccggc

SEQ ID NO: 971962 - DNA, 25 bp, Mus musculus
tttgaaatagaatggcatggccggc

SEQ ID NO: 971963 - DNA, 25 bp, Mus musculus
tttgaaatgcccacttccgtgtctg

SEQ ID NO: 971964 - DNA, 25 bp, Mus musculus
tttgaaatgccctcttccgtgtctg

SEQ ID NO: 971965 - DNA, 25 bp, Mus musculus
tttgaaatggcactgtcctctggca

SEQ ID NO: 971966 - DNA, 25 bp, Mus musculus
tttgaaatggcagtgtcctctggca

SEQ ID NO: 971967 - DNA, 25 bp, Mus musculus
tttgaaatggccatgacagtatccc

SEQ ID NO: 971968 - DNA, 25 bp, Mus musculus
tttgaaatggccttgacagtatccc

SEQ ID NO: 971969 - DNA, 25 bp, Mus musculus
tttgaaattaggcttcccatgtcgc

SEQ ID NO: 971970 - DNA, 25 bp, Mus musculus
tttgaaattagggttcccatgtcgc

SEQ ID NO: 971971 - DNA, 25 bp, Mus musculus
tttgaacaaactaggggctcccact

SEQ ID NO: 971972 - DNA, 25 bp, Mus musculus
tttgaacaaacttggggctcccact

SEQ ID NO: 971973 - DNA, 25 bp, Mus musculus
tttgaacacctgagggttgattcag

SEQ ID NO: 971974 - DNA, 25 bp, Mus musculus
tttgaacacctgtgggttgattcag

SEQ ID NO: 971975 - DNA, 25 bp, Mus musculus
tttgaacactgaaagcccactgctg

SEQ ID NO: 971976 - DNA, 25 bp, Mus musculus
tttgaacactgatagcccactgctg

SEQ ID NO: 971977 - DNA, 25 bp, Mus musculus
tttgaacatagcaaaggatccatct

SEQ ID NO: 971978 - DNA, 25 bp, Mus musculus
tttgaacatagctaaggatccatct

SEQ ID NO: 971979 - DNA, 25 bp, Mus musculus
tttgaacatgttcttcccatttccc

SEQ ID NO: 971980 - DNA, 25 bp, Mus musculus
tttgaacatgttgttcccatttccc

SEQ ID NO: 971981 - DNA, 25 bp, Mus musculus
tttgaacattttagccctctccgta

SEQ ID NO: 971982 - DNA, 25 bp, Mus musculus
tttgaacatttttgccctctccgta

SEQ ID NO: 971983 - DNA, 25 bp, Mus musculus
tttgaaccaccccaagcttttggat

SEQ ID NO: 971984 - DNA, 25 bp, Mus musculus
tttgaaccacccgaagcttttggat

SEQ ID NO: 971985 - DNA, 25 bp, Mus musculus
tttgaaccacctcagtccctcatgt

SEQ ID NO: 971986 - DNA, 25 bp, Mus musculus
tttgaaccacctgagtccctcatgt

SEQ ID NO: 971987 - DNA, 25 bp, Mus musculus
tttgaaccatcaaatgcccctcaga

SEQ ID NO: 971988 - DNA, 25 bp, Mus musculus
tttgaaccatcatatgcccctcaga

SEQ ID NO: 971989 - DNA, 25 bp, Mus musculus
tttgaaccatggaaagaccctcttt

SEQ ID NO: 971990 - DNA, 25 bp, Mus musculus
tttgaaccatggtaagaccctcttt

SEQ ID NO: 971991 - DNA, 25 bp, Mus musculus
tttgaacccaagaaaccgcagaata

SEQ ID NO: 971992 - DNA, 25 bp, Mus musculus
tttgaacccaagagacctgaaacaa

SEQ ID NO: 971993 - DNA, 25 bp, Mus musculus
tttgaacccaagtaaccgcagaata

SEQ ID NO: 971994 - DNA, 25 bp, Mus musculus
tttgaacccaagtgacctgaaacaa

SEQ ID NO: 971995 - DNA, 25 bp, Mus musculus
tttgaacccaatacagtctgctgcc

SEQ ID NO: 971996 - DNA, 25 bp, Mus musculus
tttgaacccaattcagtctgctgcc

SEQ ID NO: 971997 - DNA, 25 bp, Mus musculus
tttgaacccattatgagcccagaaa

SEQ ID NO: 971998 - DNA, 25 bp, Mus musculus
tttgaacccattttgagcccagaaa

SEQ ID NO: 971999 - DNA, 25 bp, Mus musculus
tttgaaccccaaatctttccattct

SEQ ID NO: 972000 - DNA, 25 bp, Mus musculus
tttgaaccccaattctttccattct

SEQ ID NO: 972001 - DNA, 25 bp, Mus musculus
tttgaaccctgtactgttacctgat

SEQ ID NO: 972002 - DNA, 25 bp, Mus musculus
tttgaaccctgttctgttacctgat

SEQ ID NO: 972003 - DNA, 25 bp, Mus musculus
tttgaaccgaagcatgaacacatct

SEQ ID NO: 972004 - DNA, 25 bp, Mus musculus
tttgaaccgaaggatgaacacatct

SEQ ID NO: 972005 - DNA, 25 bp, Mus musculus
tttgaaccgagactcaccaacagat

SEQ ID NO: 972006 - DNA, 25 bp, Mus musculus
tttgaaccgagagtcaccaacagat

SEQ ID NO: 972007 - DNA, 25 bp, Mus musculus
tttgaacctcagcagccaactgaac

SEQ ID NO: 972008 - DNA, 25 bp, Mus musculus
tttgaacctcaggagccaactgaac

SEQ ID NO: 972009 - DNA, 25 bp, Mus musculus
tttgaacctgagaatttggcacatg

SEQ ID NO: 972010 - DNA, 25 bp, Mus musculus
tttgaacctgagtatttggcacatg

SEQ ID NO: 972011 - DNA, 25 bp, Mus musculus
tttgaacctgatcccgctgatctcg

SEQ ID NO: 972012 - DNA, 25 bp, Mus musculus
tttgaacctgatgccgctgatctcg

SEQ ID NO: 972013 - DNA, 25 bp, Mus musculus
tttgaacctgtgctgcttctgcctc

SEQ ID NO: 972014 - DNA, 25 bp, Mus musculus
tttgaacctgtggtgcttctgcctc

SEQ ID NO: 972015 - DNA, 25 bp, Mus musculus
tttgaacgcaacactggcgcggagg

SEQ ID NO: 972016 - DNA, 25 bp, Mus musculus
tttgaacgcaactctggcgcggagg

SEQ ID NO: 972017 - DNA, 25 bp, Mus musculus
tttgaacgtgggaagggcgattcat

SEQ ID NO: 972018 - DNA, 25 bp, Mus musculus
tttgaacgtgggtagggcgattcat

SEQ ID NO: 972019 - DNA, 25 bp, Mus musculus
tttgaactaaccactacttttgctt

SEQ ID NO: 972020 - DNA, 25 bp, Mus musculus
tttgaactaacctctacttttgctt

SEQ ID NO: 972021 - DNA, 25 bp, Mus musculus
tttgaactaactactctccatcacc

SEQ ID NO: 972022 - DNA, 25 bp, Mus musculus
tttgaactaacttctctccatcacc

SEQ ID NO: 972023 - DNA, 25 bp, Mus musculus
tttgaactacaacctgctgctgcta

SEQ ID NO: 972024 - DNA, 25 bp, Mus musculus
tttgaactacaagctgctgctgcta

SEQ ID NO: 972025 - DNA, 25 bp, Mus musculus
tttgaactcaacacgaaaaccctga

SEQ ID NO: 972026 - DNA, 25 bp, Mus musculus
tttgaactcaactcgaaaaccctga

SEQ ID NO: 972027 - DNA, 25 bp, Mus musculus
tttgaactccataacataaggccta

SEQ ID NO: 972028 - DNA, 25 bp, Mus musculus
tttgaactccattacataaggccta

SEQ ID NO: 972029 - DNA, 25 bp, Mus musculus
tttgaactcctcatttctaggtttg

SEQ ID NO: 972030 - DNA, 25 bp, Mus musculus
tttgaactcctcttttctaggtttg

SEQ ID NO: 972031 - DNA, 25 bp, Mus musculus
tttgaactcttgcagtgagctcctc

SEQ ID NO: 972032 - DNA, 25 bp, Mus musculus
tttgaactcttggagtgagctcctc

SEQ ID NO: 972033 - DNA, 25 bp, Mus musculus
tttgaactggaccatatcctcagcc

SEQ ID NO: 972034 - DNA, 25 bp, Mus musculus
tttgaactggacgatatcctcagcc

SEQ ID NO: 972035 - DNA, 25 bp, Mus musculus
tttgaactggttactgcttcctctc

SEQ ID NO: 972036 - DNA, 25 bp, Mus musculus
tttgaactggtttctgcttcctctc

SEQ ID NO: 972037 - DNA, 25 bp, Mus musculus
tttgaacttcagcaacgtgtccatt

SEQ ID NO: 972038 - DNA, 25 bp, Mus musculus
tttgaacttcaggaacgtgtccatt

SEQ ID NO: 972039 - DNA, 25 bp, Mus musculus
tttgaacttccacagaattgcattc

SEQ ID NO: 972040 - DNA, 25 bp, Mus musculus
tttgaacttccagagaattgcattc

SEQ ID NO: 972041 - DNA, 25 bp, Mus musculus
tttgaacttgcaaacctactgcctc

SEQ ID NO: 972042 - DNA, 25 bp, Mus musculus
tttgaacttgcatacctactgcctc

SEQ ID NO: 972043 - DNA, 25 bp, Mus musculus
tttgaacttgttcgcagctctggct

SEQ ID NO: 972044 - DNA, 25 bp, Mus musculus
tttgaacttgttggcagctctggct

SEQ ID NO: 972045 - DNA, 25 bp, Mus musculus
tttgaagaacaccttgaaagtcact

SEQ ID NO: 972046 - DNA, 25 bp, Mus musculus
tttgaagaacacgttgaaagtcact

SEQ ID NO: 972047 - DNA, 25 bp, Mus musculus
tttgaagaatagagagcagacccaa

SEQ ID NO: 972048 - DNA, 25 bp, Mus musculus
tttgaagaatagtgagcagacccaa

SEQ ID NO: 972049 - DNA, 25 bp, Mus musculus
tttgaagaccatcttgcagtgcgcc

SEQ ID NO: 972050 - DNA, 25 bp, Mus musculus
tttgaagaccatgttgcagtgcgcc

SEQ ID NO: 972051 - DNA, 25 bp, Mus musculus
tttgaagaccccatgctacagacag

SEQ ID NO: 972052 - DNA, 25 bp, Mus musculus
tttgaagaccccttgctacagacag

SEQ ID NO: 972053 - DNA, 25 bp, Mus musculus
tttgaagacctactggccggagtcc

SEQ ID NO: 972054 - DNA, 25 bp, Mus musculus
tttgaagacctagtggccggagtcc

SEQ ID NO: 972055 - DNA, 25 bp, Mus musculus
tttgaagaccttccttccagcaatg

SEQ ID NO: 972056 - DNA, 25 bp, Mus musculus
tttgaagaccttgcttccagcaatg

SEQ ID NO: 972057 - DNA, 25 bp, Mus musculus
tttgaagactcaaaacattgctcct

SEQ ID NO: 972058 - DNA, 25 bp, Mus musculus
tttgaagactcataacattgctcct

SEQ ID NO: 972059 - DNA, 25 bp, Mus musculus
tttgaagactcccagtgaaggccta

SEQ ID NO: 972060 - DNA, 25 bp, Mus musculus
tttgaagactccgagtgaaggccta

SEQ ID NO: 972061 - DNA, 25 bp, Mus musculus
tttgaagactgcaccgtactgacca

SEQ ID NO: 972062 - DNA, 25 bp, Mus musculus
tttgaagactgctccgtactgacca

SEQ ID NO: 972063 - DNA, 25 bp, Mus musculus
tttgaagagaaaaccctcctcccag

SEQ ID NO: 972064 - DNA, 25 bp, Mus musculus
tttgaagagaaatccctcctcccag

SEQ ID NO: 972065 - DNA, 25 bp, Mus musculus
tttgaagagcacactcctttctcag

SEQ ID NO: 972066 - DNA, 25 bp, Mus musculus
tttgaagagcactctcctttctcag

SEQ ID NO: 972067 - DNA, 25 bp, Mus musculus
tttgaagagtcaaacccaccctaac

SEQ ID NO: 972068 - DNA, 25 bp, Mus musculus
tttgaagagtcatacccaccctaac

SEQ ID NO: 972069 - DNA, 25 bp, Mus musculus
tttgaagcagagcagagttactact

SEQ ID NO: 972070 - DNA, 25 bp, Mus musculus
tttgaagcagaggagagttactact

SEQ ID NO: 972071 - DNA, 25 bp, Mus musculus
tttgaagcagcacactacagttata

SEQ ID NO: 972072 - DNA, 25 bp, Mus musculus
tttgaagcagcagactacagttata

SEQ ID NO: 972073 - DNA, 25 bp, Mus musculus
tttgaagcatttactcgactctatg

SEQ ID NO: 972074 - DNA, 25 bp, Mus musculus
tttgaagcattttctcgactctatg

SEQ ID NO: 972075 - DNA, 25 bp, Mus musculus
tttgaagccaagaaagtaggtctct

SEQ ID NO: 972076 - DNA, 25 bp, Mus musculus
tttgaagccaagtaagtaggtctct

SEQ ID NO: 972077 - DNA, 25 bp, Mus musculus
tttgaagccaggctcttacctacta

SEQ ID NO: 972078 - DNA, 25 bp, Mus musculus
tttgaagccagggtcttacctacta

SEQ ID NO: 972079 - DNA, 25 bp, Mus musculus
tttgaagcccaaagcctagaaaata

SEQ ID NO: 972080 - DNA, 25 bp, Mus musculus
tttgaagcccaatgcctagaaaata

SEQ ID NO: 972081 - DNA, 25 bp, Mus musculus
tttgaagccctgaattgtctttaag

SEQ ID NO: 972082 - DNA, 25 bp, Mus musculus
tttgaagccctgtattgtctttaag

SEQ ID NO: 972083 - DNA, 25 bp, Mus musculus
tttgaagccgccattaaacagcgag

SEQ ID NO: 972084 - DNA, 25 bp, Mus musculus
tttgaagccgcctttaaacagcgag

SEQ ID NO: 972085 - DNA, 25 bp, Mus musculus
tttgaagcgaccctctcactctagg

SEQ ID NO: 972086 - DNA, 25 bp, Mus musculus
tttgaagcgaccgtctcactctagg

SEQ ID NO: 972087 - DNA, 25 bp, Mus musculus
tttgaagcgactctcaactcagcca

SEQ ID NO: 972088 - DNA, 25 bp, Mus musculus
tttgaagcgactgtcaactcagcca

SEQ ID NO: 972089 - DNA, 25 bp, Mus musculus
tttgaagctgctaccttagcgacca

SEQ ID NO: 972090 - DNA, 25 bp, Mus musculus
tttgaagctgcttccttagcgacca

SEQ ID NO: 972091 - DNA, 25 bp, Mus musculus
tttgaagctgtaatgaccttactgc

SEQ ID NO: 972092 - DNA, 25 bp, Mus musculus
tttgaagctgtattgaccttactgc

SEQ ID NO: 972093 - DNA, 25 bp, Mus musculus
tttgaagctttcacttggctccaga

SEQ ID NO: 972094 - DNA, 25 bp, Mus musculus
tttgaagctttctcttggctccaga

SEQ ID NO: 972095 - DNA, 25 bp, Mus musculus
tttgaaggacctagaactgatgctg

SEQ ID NO: 972096 - DNA, 25 bp, Mus musculus
tttgaaggaccttgaactgatgctg

SEQ ID NO: 972097 - DNA, 25 bp, Mus musculus
tttgaaggagcccacatttggaccc

SEQ ID NO: 972098 - DNA, 25 bp, Mus musculus
tttgaaggagccctgagacagagct

SEQ ID NO: 972099 - DNA, 25 bp, Mus musculus
tttgaaggagccgacatttggaccc

SEQ ID NO: 972100 - DNA, 25 bp, Mus musculus
tttgaaggagccgtgagacagagct

SEQ ID NO: 972101 - DNA, 25 bp, Mus musculus
tttgaaggatcaccctgaacttggg

SEQ ID NO: 972102 - DNA, 25 bp, Mus musculus
tttgaaggatcagcctgaacttggg

SEQ ID NO: 972103 - DNA, 25 bp, Mus musculus
tttgaaggccaaacgaccgctgttc

SEQ ID NO: 972104 - DNA, 25 bp, Mus musculus
tttgaaggccaaaggctcagccctt

SEQ ID NO: 972105 - DNA, 25 bp, Mus musculus
tttgaaggccaatcgaccgctgttc

SEQ ID NO: 972106 - DNA, 25 bp, Mus musculus
tttgaaggccaatggctcagccctt

SEQ ID NO: 972107 - DNA, 25 bp, Mus musculus
tttgaaggctccaaggcccctattc

SEQ ID NO: 972108 - DNA, 25 bp, Mus musculus
tttgaaggctcctaggcccctattc

SEQ ID NO: 972109 - DNA, 25 bp, Mus musculus
tttgaaggcttgcatgaccttgccc

SEQ ID NO: 972110 - DNA, 25 bp, Mus musculus
tttgaaggcttggatgaccttgccc

SEQ ID NO: 972111 - DNA, 25 bp, Mus musculus
tttgaagggacactaattcacctgt

SEQ ID NO: 972112 - DNA, 25 bp, Mus musculus
tttgaagggacagtaattcacctgt

SEQ ID NO: 972113 - DNA, 25 bp, Mus musculus
tttgaagggacccttcttcctcact

SEQ ID NO: 972114 - DNA, 25 bp, Mus musculus
tttgaagggaccgttcttcctcact

SEQ ID NO: 972115 - DNA, 25 bp, Mus musculus
tttgaagggtttacctgttgagctg

SEQ ID NO: 972116 - DNA, 25 bp, Mus musculus
tttgaagggtttcctaggccactcc

SEQ ID NO: 972117 - DNA, 25 bp, Mus musculus
tttgaagggtttgctaggccactcc

SEQ ID NO: 972118 - DNA, 25 bp, Mus musculus
tttgaagggttttcctgttgagctg

SEQ ID NO: 972119 - DNA, 25 bp, Mus musculus
tttgaaggtggtcaaagacacccta

SEQ ID NO: 972120 - DNA, 25 bp, Mus musculus
tttgaaggtggtgaaagacacccta

SEQ ID NO: 972121 - DNA, 25 bp, Mus musculus
tttgaaggttgtcgtttcaagacag

SEQ ID NO: 972122 - DNA, 25 bp, Mus musculus
tttgaaggttgtggtttcaagacag

SEQ ID NO: 972123 - DNA, 25 bp, Mus musculus
tttgaagtacaacggctgcagccta

SEQ ID NO: 972124 - DNA, 25 bp, Mus musculus
tttgaagtacaagggctgcagccta

SEQ ID NO: 972125 - DNA, 25 bp, Mus musculus
tttgaagtacttagacactcccagc

SEQ ID NO: 972126 - DNA, 25 bp, Mus musculus
tttgaagtactttgacactcccagc

SEQ ID NO: 972127 - DNA, 25 bp, Mus musculus
tttgaagtctatatagtgccaggac

SEQ ID NO: 972128 - DNA, 25 bp, Mus musculus
tttgaagtctatttagtgccaggac

SEQ ID NO: 972129 - DNA, 25 bp, Mus musculus
tttgaagtctccatcagccactgaa

SEQ ID NO: 972130 - DNA, 25 bp, Mus musculus
tttgaagtctccttcagccactgaa

SEQ ID NO: 972131 - DNA, 25 bp, Mus musculus
tttgaagtgaacacccgaccttgaa

SEQ ID NO: 972132 - DNA, 25 bp, Mus musculus
tttgaagtgaactcccgaccttgaa

SEQ ID NO: 972133 - DNA, 25 bp, Mus musculus
tttgaagtgcgtctgttgctgctta

SEQ ID NO: 972134 - DNA, 25 bp, Mus musculus
tttgaagtgcgtgtgttgctgctta

SEQ ID NO: 972135 - DNA, 25 bp, Mus musculus
tttgaagtgctcctcatcgccacag

SEQ ID NO: 972136 - DNA, 25 bp, Mus musculus
tttgaagtgctcgtcatcgccacag

SEQ ID NO: 972137 - DNA, 25 bp, Mus musculus
tttgaagtggcaactttgagctggg

SEQ ID NO: 972138 - DNA, 25 bp, Mus musculus
tttgaagtggcatctttgagctggg

SEQ ID NO: 972139 - DNA, 25 bp, Mus musculus
tttgaagttcttagtcggctctgta

SEQ ID NO: 972140 - DNA, 25 bp, Mus musculus
tttgaagttctttgtcggctctgta

SEQ ID NO: 972141 - DNA, 25 bp, Mus musculus
tttgaagttgccagtcttcctctaa

SEQ ID NO: 972142 - DNA, 25 bp, Mus musculus
tttgaagttgcctgtcttcctctaa

SEQ ID NO: 972143 - DNA, 25 bp, Mus musculus
tttgaagtttggatgttgagctaat

SEQ ID NO: 972144 - DNA, 25 bp, Mus musculus
tttgaagtttggttgttgagctaat

SEQ ID NO: 972145 - DNA, 25 bp, Mus musculus
tttgaataacctagaatacatctta

SEQ ID NO: 972146 - DNA, 25 bp, Mus musculus
tttgaataaccttgaatacatctta

SEQ ID NO: 972147 - DNA, 25 bp, Mus musculus
tttgaatacaacagcccttatatgt

SEQ ID NO: 972148 - DNA, 25 bp, Mus musculus
tttgaatacaactgcccttatatgt

SEQ ID NO: 972149 - DNA, 25 bp, Mus musculus
tttgaatacaagctgtgtggcctca

SEQ ID NO: 972150 - DNA, 25 bp, Mus musculus
tttgaatacaaggtgtgtggcctca

SEQ ID NO: 972151 - DNA, 25 bp, Mus musculus
tttgaatagtaaaggctcccatatg

SEQ ID NO: 972152 - DNA, 25 bp, Mus musculus
tttgaatagtaatggctcccatatg

SEQ ID NO: 972153 - DNA, 25 bp, Mus musculus
tttgaatatcatccccagaacacag

SEQ ID NO: 972154 - DNA, 25 bp, Mus musculus
tttgaatatcatgcccagaacacag

SEQ ID NO: 972155 - DNA, 25 bp, Mus musculus
tttgaatcataccaataccaatcgt

SEQ ID NO: 972156 - DNA, 25 bp, Mus musculus
tttgaatcatacgaataccaatcgt

SEQ ID NO: 972157 - DNA, 25 bp, Mus musculus
tttgaatccaacattccatagccca

SEQ ID NO: 972158 - DNA, 25 bp, Mus musculus
tttgaatccaactttccatagccca

SEQ ID NO: 972159 - DNA, 25 bp, Mus musculus
tttgaatccaccctggagccccaag

SEQ ID NO: 972160 - DNA, 25 bp, Mus musculus
tttgaatccaccgtggagccccaag

SEQ ID NO: 972161 - DNA, 25 bp, Mus musculus
tttgaatctcctagatactcctggc

SEQ ID NO: 972162 - DNA, 25 bp, Mus musculus
tttgaatctccttgatactcctggc

SEQ ID NO: 972163 - DNA, 25 bp, Mus musculus
tttgaatgaacactcccagaaccca

SEQ ID NO: 972164 - DNA, 25 bp, Mus musculus
tttgaatgaacagtcccagaaccca

SEQ ID NO: 972165 - DNA, 25 bp, Mus musculus
tttgaatgacaaacccagactctag

SEQ ID NO: 972166 - DNA, 25 bp, Mus musculus
tttgaatgacaacaccagtttctct

SEQ ID NO: 972167 - DNA, 25 bp, Mus musculus
tttgaatgacaagaccagtttctct

SEQ ID NO: 972168 - DNA, 25 bp, Mus musculus
tttgaatgacaatcccagactctag

SEQ ID NO: 972169 - DNA, 25 bp, Mus musculus
tttgaatgagccacagatgagatcc

SEQ ID NO: 972170 - DNA, 25 bp, Mus musculus
tttgaatgagcctcagatgagatcc

SEQ ID NO: 972171 - DNA, 25 bp, Mus musculus
tttgaatgagggacagtttagcggt

SEQ ID NO: 972172 - DNA, 25 bp, Mus musculus
tttgaatgagggtcagtttagcggt

SEQ ID NO: 972173 - DNA, 25 bp, Mus musculus
tttgaatgccacactcactgtctta

SEQ ID NO: 972174 - DNA, 25 bp, Mus musculus
tttgaatgccactctcactgtctta

SEQ ID NO: 972175 - DNA, 25 bp, Mus musculus
tttgaatggctgattaccctgtctt

SEQ ID NO: 972176 - DNA, 25 bp, Mus musculus
tttgaatggctgtttaccctgtctt

SEQ ID NO: 972177 - DNA, 25 bp, Mus musculus
tttgaatgggatccctttgctaaag

SEQ ID NO: 972178 - DNA, 25 bp, Mus musculus
tttgaatgggatgcctttgctaaag

SEQ ID NO: 972179 - DNA, 25 bp, Mus musculus
tttgaatgggctagttcttcctacc

SEQ ID NO: 972180 - DNA, 25 bp, Mus musculus
tttgaatgggcttgttcttcctacc

SEQ ID NO: 972181 - DNA, 25 bp, Mus musculus
tttgaatgtccgagcacagcccttt

SEQ ID NO: 972182 - DNA, 25 bp, Mus musculus
tttgaatgtccgtgcacagcccttt

SEQ ID NO: 972183 - DNA, 25 bp, Mus musculus
tttgaatgtcggacgggttcacctg

SEQ ID NO: 972184 - DNA, 25 bp, Mus musculus
tttgaatgtcggtcgggttcacctg

SEQ ID NO: 972185 - DNA, 25 bp, Mus musculus
tttgaatgtctgaaaccctgactgt

SEQ ID NO: 972186 - DNA, 25 bp, Mus musculus
tttgaatgtctgtaaccctgactgt

SEQ ID NO: 972187 - DNA, 25 bp, Mus musculus
tttgaattacacatgctggcttcag

SEQ ID NO: 972188 - DNA, 25 bp, Mus musculus
tttgaattacacttgctggcttcag

SEQ ID NO: 972189 - DNA, 25 bp, Mus musculus
tttgaattccccagcaggtttaatt

SEQ ID NO: 972190 - DNA, 25 bp, Mus musculus
tttgaattcccctgcaggtttaatt

SEQ ID NO: 972191 - DNA, 25 bp, Mus musculus
tttgaattcccgctctgtagatctg

SEQ ID NO: 972192 - DNA, 25 bp, Mus musculus
tttgaattcccggtctgtagatctg

SEQ ID NO: 972193 - DNA, 25 bp, Mus musculus
tttgaattgccactctcttttttga

SEQ ID NO: 972194 - DNA, 25 bp, Mus musculus
tttgaattgccagtctcttttttga

SEQ ID NO: 972195 - DNA, 25 bp, Mus musculus
tttgaattgctaccaacggccttag

SEQ ID NO: 972196 - DNA, 25 bp, Mus musculus
tttgaattgctagcaacggccttag

SEQ ID NO: 972197 - DNA, 25 bp, Mus musculus
tttgaattgtaaccaagtgaacttg

SEQ ID NO: 972198 - DNA, 25 bp, Mus musculus
tttgaattgtaagcaagtgaacttg

SEQ ID NO: 972199 - DNA, 25 bp, Mus musculus
tttgaattgtttctgggcccatgcc

SEQ ID NO: 972200 - DNA, 25 bp, Mus musculus
tttgaattgtttgtgggcccatgcc

SEQ ID NO: 972201 - DNA, 25 bp, Mus musculus
tttgaatttaggcagtgggagcacc

SEQ ID NO: 972202 - DNA, 25 bp, Mus musculus
tttgaatttagggagtgggagcacc

SEQ ID NO: 972203 - DNA, 25 bp, Mus musculus
tttgaatttatcagagcacaagaag

SEQ ID NO: 972204 - DNA, 25 bp, Mus musculus
tttgaatttatctgagcacaagaag

SEQ ID NO: 972205 - DNA, 25 bp, Mus musculus
tttgaatttcacctccctttctgaa

SEQ ID NO: 972206 - DNA, 25 bp, Mus musculus
tttgaatttcacgtccctttctgaa

SEQ ID NO: 972207 - DNA, 25 bp, Mus musculus
tttgaatttcgactggtcaccccac

SEQ ID NO: 972208 - DNA, 25 bp, Mus musculus
tttgaatttcgagtggtcaccccac

SEQ ID NO: 972209 - DNA, 25 bp, Mus musculus
tttgacaacccactctaccagaaga

SEQ ID NO: 972210 - DNA, 25 bp, Mus musculus
tttgacaacccagtctaccagaaga

SEQ ID NO: 972211 - DNA, 25 bp, Mus musculus
tttgacaaccttagtctctccctgt

SEQ ID NO: 972212 - DNA, 25 bp, Mus musculus
tttgacaacctttgtctctccctgt

SEQ ID NO: 972213 - DNA, 25 bp, Mus musculus
tttgacaactctaggctgcctgtaa

SEQ ID NO: 972214 - DNA, 25 bp, Mus musculus
tttgacaactcttggctgcctgtaa

SEQ ID NO: 972215 - DNA, 25 bp, Mus musculus
tttgacaagaacacagcatccctgc

SEQ ID NO: 972216 - DNA, 25 bp, Mus musculus
tttgacaagaactcagcatccctgc

SEQ ID NO: 972217 - DNA, 25 bp, Mus musculus
tttgacaagcataccgattttgtta

SEQ ID NO: 972218 - DNA, 25 bp, Mus musculus
tttgacaagcattccgattttgtta

SEQ ID NO: 972219 - DNA, 25 bp, Mus musculus
tttgacaagctgctctacaacggca

SEQ ID NO: 972220 - DNA, 25 bp, Mus musculus
tttgacaagctggtctacaacggca

SEQ ID NO: 972221 - DNA, 25 bp, Mus musculus
tttgacaatcttagttccaccacac

SEQ ID NO: 972222 - DNA, 25 bp, Mus musculus
tttgacaatctttgttccaccacac

SEQ ID NO: 972223 - DNA, 25 bp, Mus musculus
tttgacaatgttcagtccctcctga

SEQ ID NO: 972224 - DNA, 25 bp, Mus musculus
tttgacaatgttgagtccctcctga

SEQ ID NO: 972225 - DNA, 25 bp, Mus musculus
tttgacaccctactgacccttgaag

SEQ ID NO: 972226 - DNA, 25 bp, Mus musculus
tttgacaccctagtgacccttgaag

SEQ ID NO: 972227 - DNA, 25 bp, Mus musculus
tttgacacgctgacagccatggaga

SEQ ID NO: 972228 - DNA, 25 bp, Mus musculus
tttgacacgctgtcagccatggaga

SEQ ID NO: 972229 - DNA, 25 bp, Mus musculus
tttgacacggttcgccgtcgtatga

SEQ ID NO: 972230 - DNA, 25 bp, Mus musculus
tttgacacggttggccgtcgtatga

SEQ ID NO: 972231 - DNA, 25 bp, Mus musculus
tttgacacgtagcattttctcttta

SEQ ID NO: 972232 - DNA, 25 bp, Mus musculus
tttgacacgtaggattttctcttta

SEQ ID NO: 972233 - DNA, 25 bp, Mus musculus
tttgacagaccacccacaccatgga

SEQ ID NO: 972234 - DNA, 25 bp, Mus musculus
tttgacagaccagccacaccatgga

SEQ ID NO: 972235 - DNA, 25 bp, Mus musculus
tttgacagacccattagcccaagaa

SEQ ID NO: 972236 - DNA, 25 bp, Mus musculus
tttgacagaccctttagcccaagaa

SEQ ID NO: 972237 - DNA, 25 bp, Mus musculus
tttgacagccggagtgaacgccagc

SEQ ID NO: 972238 - DNA, 25 bp, Mus musculus
tttgacagccggtgtgaacgccagc

SEQ ID NO: 972239 - DNA, 25 bp, Mus musculus
tttgacagcgtcatccatttaggct

SEQ ID NO: 972240 - DNA, 25 bp, Mus musculus
tttgacagcgtcttccatttaggct

SEQ ID NO: 972241 - DNA, 25 bp, Mus musculus
tttgacagcttgcagccatcagttc

SEQ ID NO: 972242 - DNA, 25 bp, Mus musculus
tttgacagcttggagccatcagttc

SEQ ID NO: 972243 - DNA, 25 bp, Mus musculus
tttgacaggttcacagtatctgccc

SEQ ID NO: 972244 - DNA, 25 bp, Mus musculus
tttgacaggttctcagtatctgccc

SEQ ID NO: 972245 - DNA, 25 bp, Mus musculus
tttgacagtcctaatttcaggtgac

SEQ ID NO: 972246 - DNA, 25 bp, Mus musculus
tttgacagtccttatttcaggtgac

SEQ ID NO: 972247 - DNA, 25 bp, Mus musculus
tttgacagttgcatacacccatgaa

SEQ ID NO: 972248 - DNA, 25 bp, Mus musculus
tttgacagttgcttacacccatgaa

SEQ ID NO: 972249 - DNA, 25 bp, Mus musculus
tttgacataattatccacactctgg

SEQ ID NO: 972250 - DNA, 25 bp, Mus musculus
tttgacataattttccacactctgg

SEQ ID NO: 972251 - DNA, 25 bp, Mus musculus
tttgacatacgcctccttaaacatg

SEQ ID NO: 972252 - DNA, 25 bp, Mus musculus
tttgacatacgcgtccttaaacatg

SEQ ID NO: 972253 - DNA, 25 bp, Mus musculus
tttgacatatgccactgtggagtat

SEQ ID NO: 972254 - DNA, 25 bp, Mus musculus
tttgacatatgcgactgtggagtat

SEQ ID NO: 972255 - DNA, 25 bp, Mus musculus
tttgacatccaaatgcaggcacatc

SEQ ID NO: 972256 - DNA, 25 bp, Mus musculus
tttgacatccaattgcaggcacatc

SEQ ID NO: 972257 - DNA, 25 bp, Mus musculus
tttgacatccatatctttcccataa

SEQ ID NO: 972258 - DNA, 25 bp, Mus musculus
tttgacatccatttctttcccataa

SEQ ID NO: 972259 - DNA, 25 bp, Mus musculus
tttgacatcctaaaagcttgagaga

SEQ ID NO: 972260 - DNA, 25 bp, Mus musculus
tttgacatcctataagcttgagaga

SEQ ID NO: 972261 - DNA, 25 bp, Mus musculus
tttgacatcgacagctggaggctgg

SEQ ID NO: 972262 - DNA, 25 bp, Mus musculus
tttgacatcgactgctggaggctgg

SEQ ID NO: 972263 - DNA, 25 bp, Mus musculus
tttgacatcgagaggtgtgaccgcc

SEQ ID NO: 972264 - DNA, 25 bp, Mus musculus
tttgacatcgagtggtgtgaccgcc

SEQ ID NO: 972265 - DNA, 25 bp, Mus musculus
tttgacatctcccaactgaacttga

SEQ ID NO: 972266 - DNA, 25 bp, Mus musculus
tttgacatctccgaactgaacttga

SEQ ID NO: 972267 - DNA, 25 bp, Mus musculus
tttgacatctctacgcctctatgaa

SEQ ID NO: 972268 - DNA, 25 bp, Mus musculus
tttgacatctcttcgcctctatgaa

SEQ ID NO: 972269 - DNA, 25 bp, Mus musculus
tttgacatgacgacacatcctctca

SEQ ID NO: 972270 - DNA, 25 bp, Mus musculus
tttgacatgacgtcacatcctctca

SEQ ID NO: 972271 - DNA, 25 bp, Mus musculus
tttgacatgcagctcaatccgtggg

SEQ ID NO: 972272 - DNA, 25 bp, Mus musculus
tttgacatgcaggtcaatccgtggg

SEQ ID NO: 972273 - DNA, 25 bp, Mus musculus
tttgacatgcctcggttgtgatcat

SEQ ID NO: 972274 - DNA, 25 bp, Mus musculus
tttgacatgcctgggttgtgatcat

SEQ ID NO: 972275 - DNA, 25 bp, Mus musculus
tttgacatggagagcctcagaatgg

SEQ ID NO: 972276 - DNA, 25 bp, Mus musculus
tttgacatggagtgcctcagaatgg

SEQ ID NO: 972277 - DNA, 25 bp, Mus musculus
tttgacatgtgtcggtgatttgcct

SEQ ID NO: 972278 - DNA, 25 bp, Mus musculus
tttgacatgtgtgggtgatttgcct

SEQ ID NO: 972279 - DNA, 25 bp, Mus musculus
tttgacattgtaacagcctgcttgc

SEQ ID NO: 972280 - DNA, 25 bp, Mus musculus
tttgacattgtatcagcctgcttgc

SEQ ID NO: 972281 - DNA, 25 bp, Mus musculus
tttgaccaaagacggaaacgagact

SEQ ID NO: 972282 - DNA, 25 bp, Mus musculus
tttgaccaaagagggaaacgagact

SEQ ID NO: 972283 - DNA, 25 bp, Mus musculus
tttgaccaagacattacgcgggaag

SEQ ID NO: 972284 - DNA, 25 bp, Mus musculus
tttgaccaagactttacgcgggaag

SEQ ID NO: 972285 - DNA, 25 bp, Mus musculus
tttgaccactacatccgattctgtt

SEQ ID NO: 972286 - DNA, 25 bp, Mus musculus
tttgaccactacttccgattctgtt

SEQ ID NO: 972287 - DNA, 25 bp, Mus musculus
tttgaccacttgctaccttacctta

SEQ ID NO: 972288 - DNA, 25 bp, Mus musculus
tttgaccacttggtaccttacctta

SEQ ID NO: 972289 - DNA, 25 bp, Mus musculus
tttgaccagagacacaactccagtg

SEQ ID NO: 972290 - DNA, 25 bp, Mus musculus
tttgaccagagaccgtttccttctt

SEQ ID NO: 972291 - DNA, 25 bp, Mus musculus
tttgaccagagagacaactccagtg

SEQ ID NO: 972292 - DNA, 25 bp, Mus musculus
tttgaccagagagcgtttccttctt

SEQ ID NO: 972293 - DNA, 25 bp, Mus musculus
tttgaccagatgagcggtggaccag

SEQ ID NO: 972294 - DNA, 25 bp, Mus musculus
tttgaccagatgtgcggtggaccag

SEQ ID NO: 972295 - DNA, 25 bp, Mus musculus
tttgaccaggtgacatatacatgac

SEQ ID NO: 972296 - DNA, 25 bp, Mus musculus
tttgaccaggtgtcatatacatgac

SEQ ID NO: 972297 - DNA, 25 bp, Mus musculus
tttgaccataagaccacctgacagg

SEQ ID NO: 972298 - DNA, 25 bp, Mus musculus
tttgaccataagtccacctgacagg

SEQ ID NO: 972299 - DNA, 25 bp, Mus musculus
tttgaccatgtaaagacctcatccc

SEQ ID NO: 972300 - DNA, 25 bp, Mus musculus
tttgaccatgtatagacctcatccc

SEQ ID NO: 972301 - DNA, 25 bp, Mus musculus
tttgacccaacacaaggaggcctct

SEQ ID NO: 972302 - DNA, 25 bp, Mus musculus
tttgacccaacagaaggaggcctct

SEQ ID NO: 972303 - DNA, 25 bp, Mus musculus
tttgacccacctagtataagccaca

SEQ ID NO: 972304 - DNA, 25 bp, Mus musculus
tttgacccaccttgtataagccaca

SEQ ID NO: 972305 - DNA, 25 bp, Mus musculus
tttgacccactaccagcacagtaaa

SEQ ID NO: 972306 - DNA, 25 bp, Mus musculus
tttgacccactagcagcacagtaaa

SEQ ID NO: 972307 - DNA, 25 bp, Mus musculus
tttgacccagacatttaagtatctt

SEQ ID NO: 972308 - DNA, 25 bp, Mus musculus
tttgacccagacttttaagtatctt

SEQ ID NO: 972309 - DNA, 25 bp, Mus musculus
tttgacccctgaagcctttgatggt

SEQ ID NO: 972310 - DNA, 25 bp, Mus musculus
tttgacccctgatgcctttgatggt

SEQ ID NO: 972311 - DNA, 25 bp, Mus musculus
tttgaccccttcactaggcaatttt

SEQ ID NO: 972312 - DNA, 25 bp, Mus musculus
tttgaccccttccagtaagtaaatg

SEQ ID NO: 972313 - DNA, 25 bp, Mus musculus
tttgaccccttcgagtaagtaaatg

SEQ ID NO: 972314 - DNA, 25 bp, Mus musculus
tttgaccccttctctaggcaatttt

SEQ ID NO: 972315 - DNA, 25 bp, Mus musculus
tttgaccctcagaagcttttacaga

SEQ ID NO: 972316 - DNA, 25 bp, Mus musculus
tttgaccctcagactggcaaatact

SEQ ID NO: 972317 - DNA, 25 bp, Mus musculus
tttgaccctcagtagcttttacaga

SEQ ID NO: 972318 - DNA, 25 bp, Mus musculus
tttgaccctcagtctggcaaatact

SEQ ID NO: 972319 - DNA, 25 bp, Mus musculus
tttgaccctccgaatgagttatact

SEQ ID NO: 972320 - DNA, 25 bp, Mus musculus
tttgaccctccgtatgagttatact

SEQ ID NO: 972321 - DNA, 25 bp, Mus musculus
tttgaccctgaaataggacccgcgt

SEQ ID NO: 972322 - DNA, 25 bp, Mus musculus
tttgaccctgaattaggacccgcgt

SEQ ID NO: 972323 - DNA, 25 bp, Mus musculus
tttgaccctggcaagtccggactat

SEQ ID NO: 972324 - DNA, 25 bp, Mus musculus
tttgaccctggctagtccggactat

SEQ ID NO: 972325 - DNA, 25 bp, Mus musculus
tttgaccctggtcctttctaagaat

SEQ ID NO: 972326 - DNA, 25 bp, Mus musculus
tttgaccctggtgctttctaagaat

SEQ ID NO: 972327 - DNA, 25 bp, Mus musculus
tttgaccctgtaattctgctgatta

SEQ ID NO: 972328 - DNA, 25 bp, Mus musculus
tttgaccctgtatttctgctgatta

SEQ ID NO: 972329 - DNA, 25 bp, Mus musculus
tttgaccgaccaagagtgctctttt

SEQ ID NO: 972330 - DNA, 25 bp, Mus musculus
tttgaccgaccatgagtgctctttt

SEQ ID NO: 972331 - DNA, 25 bp, Mus musculus
tttgaccgcctgattctcactggag

SEQ ID NO: 972332 - DNA, 25 bp, Mus musculus
tttgaccgcctgtttctcactggag

SEQ ID NO: 972333 - DNA, 25 bp, Mus musculus
tttgaccgggatacgtggagacatc

SEQ ID NO: 972334 - DNA, 25 bp, Mus musculus
tttgaccgggattcgtggagacatc

SEQ ID NO: 972335 - DNA, 25 bp, Mus musculus
tttgaccgtcaccatggcaacatgc

SEQ ID NO: 972336 - DNA, 25 bp, Mus musculus
tttgaccgtcacgatggcaacatgc

SEQ ID NO: 972337 - DNA, 25 bp, Mus musculus
tttgacctacgtcatgcgggccgga

SEQ ID NO: 972338 - DNA, 25 bp, Mus musculus
tttgacctacgtgatgcgggccgga

SEQ ID NO: 972339 - DNA, 25 bp, Mus musculus
tttgacctaggtcctggatacagag

SEQ ID NO: 972340 - DNA, 25 bp, Mus musculus
tttgacctaggtgctggatacagag

SEQ ID NO: 972341 - DNA, 25 bp, Mus musculus
tttgacctattgaaagtgtccttca

SEQ ID NO: 972342 - DNA, 25 bp, Mus musculus
tttgacctattgtaagtgtccttca

SEQ ID NO: 972343 - DNA, 25 bp, Mus musculus
tttgacctccaacctgacattgtaa

SEQ ID NO: 972344 - DNA, 25 bp, Mus musculus
tttgacctccaagctgacattgtaa

SEQ ID NO: 972345 - DNA, 25 bp, Mus musculus
tttgacctccgcacaagtcaggtat

SEQ ID NO: 972346 - DNA, 25 bp, Mus musculus
tttgacctccgctcaagtcaggtat

SEQ ID NO: 972347 - DNA, 25 bp, Mus musculus
tttgacctcctcatgacgagagtgg

SEQ ID NO: 972348 - DNA, 25 bp, Mus musculus
tttgacctcctccaggacacatatg

SEQ ID NO: 972349 - DNA, 25 bp, Mus musculus
tttgacctcctcgaggacacatatg

SEQ ID NO: 972350 - DNA, 25 bp, Mus musculus
tttgacctcctcttgacgagagtgg

SEQ ID NO: 972351 - DNA, 25 bp, Mus musculus
tttgacctcgatccctggcctgagg

SEQ ID NO: 972352 - DNA, 25 bp, Mus musculus
tttgacctcgatgcctggcctgagg

SEQ ID NO: 972353 - DNA, 25 bp, Mus musculus
tttgacctctaaagaacctcagtgc

SEQ ID NO: 972354 - DNA, 25 bp, Mus musculus
tttgacctctaatgaacctcagtgc

SEQ ID NO: 972355 - DNA, 25 bp, Mus musculus
tttgacctctggcattaaagcttcc

SEQ ID NO: 972356 - DNA, 25 bp, Mus musculus
tttgacctctgggattaaagcttcc

SEQ ID NO: 972357 - DNA, 25 bp, Mus musculus
tttgacctcttacctactttcagaa

SEQ ID NO: 972358 - DNA, 25 bp, Mus musculus
tttgacctcttagctactttcagaa

SEQ ID NO: 972359 - DNA, 25 bp, Mus musculus
tttgacctcttccattctgatggga

SEQ ID NO: 972360 - DNA, 25 bp, Mus musculus
tttgacctcttcgattctgatggga

SEQ ID NO: 972361 - DNA, 25 bp, Mus musculus
tttgacctgatgatcggcgacacga

SEQ ID NO: 972362 - DNA, 25 bp, Mus musculus
tttgacctgatgttcggcgacacga

SEQ ID NO: 972363 - DNA, 25 bp, Mus musculus
tttgacctgccaaccgttgctgagg

SEQ ID NO: 972364 - DNA, 25 bp, Mus musculus
tttgacctgccatccgttgctgagg

SEQ ID NO: 972365 - DNA, 25 bp, Mus musculus
tttgacctgctcacctcaatgtggc

SEQ ID NO: 972366 - DNA, 25 bp, Mus musculus
tttgacctgctctcctcaatgtggc

SEQ ID NO: 972367 - DNA, 25 bp, Mus musculus
tttgacctgctgatcctgggagtgg

SEQ ID NO: 972368 - DNA, 25 bp, Mus musculus
tttgacctgctgttcctgggagtgg

SEQ ID NO: 972369 - DNA, 25 bp, Mus musculus
tttgacctggagaaacatggaacct

SEQ ID NO: 972370 - DNA, 25 bp, Mus musculus
tttgacctggagtaacatggaacct

SEQ ID NO: 972371 - DNA, 25 bp, Mus musculus
tttgacctggccaggcagtatgggc

SEQ ID NO: 972372 - DNA, 25 bp, Mus musculus
tttgacctggcctggcagtatgggc

SEQ ID NO: 972373 - DNA, 25 bp, Mus musculus
tttgacctgtatcatcttgctaatg

SEQ ID NO: 972374 - DNA, 25 bp, Mus musculus
tttgacctgtatgatcttgctaatg

SEQ ID NO: 972375 - DNA, 25 bp, Mus musculus
tttgaccttgataccacaatgcctt

SEQ ID NO: 972376 - DNA, 25 bp, Mus musculus
tttgaccttgattccacaatgcctt

SEQ ID NO: 972377 - DNA, 25 bp, Mus musculus
tttgacctttaacccatggctggtt

SEQ ID NO: 972378 - DNA, 25 bp, Mus musculus
tttgacctttaagccatggctggtt

SEQ ID NO: 972379 - DNA, 25 bp, Mus musculus
tttgacgagctcacagctgttcctg

SEQ ID NO: 972380 - DNA, 25 bp, Mus musculus
tttgacgagctctcagctgttcctg

SEQ ID NO: 972381 - DNA, 25 bp, Mus musculus
tttgacgatgaccatcagggcccac

SEQ ID NO: 972382 - DNA, 25 bp, Mus musculus
tttgacgatgacgatcagggcccac

SEQ ID NO: 972383 - DNA, 25 bp, Mus musculus
tttgacgctgttccctaagcgtcct

SEQ ID NO: 972384 - DNA, 25 bp, Mus musculus
tttgacgctgttgcctaagcgtcct

SEQ ID NO: 972385 - DNA, 25 bp, Mus musculus
tttgacggtgacacagttgctgcaa

SEQ ID NO: 972386 - DNA, 25 bp, Mus musculus
tttgacggtgactcagttgctgcaa

SEQ ID NO: 972387 - DNA, 25 bp, Mus musculus
tttgacgtccgtcccagtgaaaagg

SEQ ID NO: 972388 - DNA, 25 bp, Mus musculus
tttgacgtccgtgccagtgaaaagg

SEQ ID NO: 972389 - DNA, 25 bp, Mus musculus
tttgacgtctatccccagcacctgg

SEQ ID NO: 972390 - DNA, 25 bp, Mus musculus
tttgacgtctatgcccagcacctgg

SEQ ID NO: 972391 - DNA, 25 bp, Mus musculus
tttgacgtgtaccttgacatctgtg

SEQ ID NO: 972392 - DNA, 25 bp, Mus musculus
tttgacgtgtacgttgacatctgtg

SEQ ID NO: 972393 - DNA, 25 bp, Mus musculus
tttgactacatgactgtgagggagt

SEQ ID NO: 972394 - DNA, 25 bp, Mus musculus
tttgactacatgtctgtgagggagt

SEQ ID NO: 972395 - DNA, 25 bp, Mus musculus
tttgactaggacactactgttgccc

SEQ ID NO: 972396 - DNA, 25 bp, Mus musculus
tttgactaggactctactgttgccc

SEQ ID NO: 972397 - DNA, 25 bp, Mus musculus
tttgactagtatcatagcactgcta

SEQ ID NO: 972398 - DNA, 25 bp, Mus musculus
tttgactagtatgatagcactgcta

SEQ ID NO: 972399 - DNA, 25 bp, Mus musculus
tttgactagtctccattatgccagc

SEQ ID NO: 972400 - DNA, 25 bp, Mus musculus
tttgactagtctgcattatgccagc

SEQ ID NO: 972401 - DNA, 25 bp, Mus musculus
tttgactcaacaaatgacatttcag

SEQ ID NO: 972402 - DNA, 25 bp, Mus musculus
tttgactcaacatatgacatttcag

SEQ ID NO: 972403 - DNA, 25 bp, Mus musculus
tttgactccaatcctgcttgggaac

SEQ ID NO: 972404 - DNA, 25 bp, Mus musculus
tttgactccaatgctgcttgggaac

SEQ ID NO: 972405 - DNA, 25 bp, Mus musculus
tttgactccagtcggctaaagagcc

SEQ ID NO: 972406 - DNA, 25 bp, Mus musculus
tttgactccagtgggctaaagagcc

SEQ ID NO: 972407 - DNA, 25 bp, Mus musculus
tttgactcccctaagcctataagaa

SEQ ID NO: 972408 - DNA, 25 bp, Mus musculus
tttgactccccttagcctataagaa

SEQ ID NO: 972409 - DNA, 25 bp, Mus musculus
tttgactccctgacttcaagccagg

SEQ ID NO: 972410 - DNA, 25 bp, Mus musculus
tttgactccctgtcttcaagccagg

SEQ ID NO: 972411 - DNA, 25 bp, Mus musculus
tttgactccttcaatttgcacacgt

SEQ ID NO: 972412 - DNA, 25 bp, Mus musculus
tttgactccttctatttgcacacgt

SEQ ID NO: 972413 - DNA, 25 bp, Mus musculus
tttgactcctttcctagctgaccta

SEQ ID NO: 972414 - DNA, 25 bp, Mus musculus
tttgactcctttgctagctgaccta

SEQ ID NO: 972415 - DNA, 25 bp, Mus musculus
tttgactcgcagctttaggaaggga

SEQ ID NO: 972416 - DNA, 25 bp, Mus musculus
tttgactcgcaggtttaggaaggga

SEQ ID NO: 972417 - DNA, 25 bp, Mus musculus
tttgactcgtttacttaactgccac

SEQ ID NO: 972418 - DNA, 25 bp, Mus musculus
tttgactcgttttcttaactgccac

SEQ ID NO: 972419 - DNA, 25 bp, Mus musculus
tttgactctaacactcaaccttcag

SEQ ID NO: 972420 - DNA, 25 bp, Mus musculus
tttgactctaactctcaaccttcag

SEQ ID NO: 972421 - DNA, 25 bp, Mus musculus
tttgactctatcaacacaggctcct

SEQ ID NO: 972422 - DNA, 25 bp, Mus musculus
tttgactctatctacacaggctcct

SEQ ID NO: 972423 - DNA, 25 bp, Mus musculus
tttgactctccaactttaggaacct

SEQ ID NO: 972424 - DNA, 25 bp, Mus musculus
tttgactctccatctttaggaacct

SEQ ID NO: 972425 - DNA, 25 bp, Mus musculus
tttgactctgtgcaaaagtgcctat

SEQ ID NO: 972426 - DNA, 25 bp, Mus musculus
tttgactctgtggaaaagtgcctat

SEQ ID NO: 972427 - DNA, 25 bp, Mus musculus
tttgactcttctcggtgccttttcc

SEQ ID NO: 972428 - DNA, 25 bp, Mus musculus
tttgactcttctgggtgccttttcc

SEQ ID NO: 972429 - DNA, 25 bp, Mus musculus
tttgactctttactctctattaggg

SEQ ID NO: 972430 - DNA, 25 bp, Mus musculus
tttgactctttagtctctattaggg

SEQ ID NO: 972431 - DNA, 25 bp, Mus musculus
tttgactgaatccaaagttcccatt

SEQ ID NO: 972432 - DNA, 25 bp, Mus musculus
tttgactgaatcgaaagttcccatt

SEQ ID NO: 972433 - DNA, 25 bp, Mus musculus
tttgactgacctagaaacttgctct

SEQ ID NO: 972434 - DNA, 25 bp, Mus musculus
tttgactgacctctcattccctttg

SEQ ID NO: 972435 - DNA, 25 bp, Mus musculus
tttgactgacctgtcattccctttg

SEQ ID NO: 972436 - DNA, 25 bp, Mus musculus
tttgactgaccttgaaacttgctct

SEQ ID NO: 972437 - DNA, 25 bp, Mus musculus
tttgactgactcaaagacttgccat

SEQ ID NO: 972438 - DNA, 25 bp, Mus musculus
tttgactgactctaagacttgccat

SEQ ID NO: 972439 - DNA, 25 bp, Mus musculus
tttgactgattaagggtttgtcctg

SEQ ID NO: 972440 - DNA, 25 bp, Mus musculus
tttgactgattatgggtttgtcctg

SEQ ID NO: 972441 - DNA, 25 bp, Mus musculus
tttgactgctaaatgcctgagccct

SEQ ID NO: 972442 - DNA, 25 bp, Mus musculus
tttgactgctaattgcctgagccct

SEQ ID NO: 972443 - DNA, 25 bp, Mus musculus
tttgactgcttaccccatagggagg

SEQ ID NO: 972444 - DNA, 25 bp, Mus musculus
tttgactgcttagcccatagggagg

SEQ ID NO: 972445 - DNA, 25 bp, Mus musculus
tttgactgtactccctgtgcagaca

SEQ ID NO: 972446 - DNA, 25 bp, Mus musculus
tttgactgtactgcctgtgcagaca

SEQ ID NO: 972447 - DNA, 25 bp, Mus musculus
tttgactgtcttcccttattacact

SEQ ID NO: 972448 - DNA, 25 bp, Mus musculus
tttgactgtcttgccttattacact

SEQ ID NO: 972449 - DNA, 25 bp, Mus musculus
tttgactgtttcatatcatcccttc

SEQ ID NO: 972450 - DNA, 25 bp, Mus musculus
tttgactgtttcttatcatcccttc

SEQ ID NO: 972451 - DNA, 25 bp, Mus musculus
tttgacttaaagaaacatgtgcgca

SEQ ID NO: 972452 - DNA, 25 bp, Mus musculus
tttgacttaaagtaacatgtgcgca

SEQ ID NO: 972453 - DNA, 25 bp, Mus musculus
tttgacttaagtaaagccttttcag

SEQ ID NO: 972454 - DNA, 25 bp, Mus musculus
tttgacttaagttaagccttttcag

SEQ ID NO: 972455 - DNA, 25 bp, Mus musculus
tttgacttacataaaatataccagg

SEQ ID NO: 972456 - DNA, 25 bp, Mus musculus
tttgacttacattaaatataccagg

SEQ ID NO: 972457 - DNA, 25 bp, Mus musculus
tttgacttacctaacacagcacctg

SEQ ID NO: 972458 - DNA, 25 bp, Mus musculus
tttgacttaccttacacagcacctg

SEQ ID NO: 972459 - DNA, 25 bp, Mus musculus
tttgacttcacgacagtgcccctcg

SEQ ID NO: 972460 - DNA, 25 bp, Mus musculus
tttgacttcacgtcagtgcccctcg

SEQ ID NO: 972461 - DNA, 25 bp, Mus musculus
tttgacttccacacctagctggaat

SEQ ID NO: 972462 - DNA, 25 bp, Mus musculus
tttgacttccactcctagctggaat

SEQ ID NO: 972463 - DNA, 25 bp, Mus musculus
tttgacttccccagacaaggcgaaa

SEQ ID NO: 972464 - DNA, 25 bp, Mus musculus
tttgacttcccctgacaaggcgaaa

SEQ ID NO: 972465 - DNA, 25 bp, Mus musculus
tttgacttggtcactcagtccggta

SEQ ID NO: 972466 - DNA, 25 bp, Mus musculus
tttgacttggtctctcagtccggta

SEQ ID NO: 972467 - DNA, 25 bp, Mus musculus
tttgacttggttacttcttgctccc

SEQ ID NO: 972468 - DNA, 25 bp, Mus musculus
tttgacttggtttcttcttgctccc

SEQ ID NO: 972469 - DNA, 25 bp, Mus musculus
tttgactttcccaggttcctcccat

SEQ ID NO: 972470 - DNA, 25 bp, Mus musculus
tttgactttccctggttcctcccat

SEQ ID NO: 972471 - DNA, 25 bp, Mus musculus
tttgactttctgacatactacttga

SEQ ID NO: 972472 - DNA, 25 bp, Mus musculus
tttgactttctgtcatactacttga

SEQ ID NO: 972473 - DNA, 25 bp, Mus musculus
tttgactttcttcgacatctggcat

SEQ ID NO: 972474 - DNA, 25 bp, Mus musculus
tttgactttcttggacatctggcat

SEQ ID NO: 972475 - DNA, 25 bp, Mus musculus
tttgactttgacagagaatgaccct

SEQ ID NO: 972476 - DNA, 25 bp, Mus musculus
tttgactttgactgagaatgaccct

SEQ ID NO: 972477 - DNA, 25 bp, Mus musculus
tttgactttgatcgcactcccagac

SEQ ID NO: 972478 - DNA, 25 bp, Mus musculus
tttgactttgatggcactcccagac

SEQ ID NO: 972479 - DNA, 25 bp, Mus musculus
tttgacttttggatggctgggacta

SEQ ID NO: 972480 - DNA, 25 bp, Mus musculus
tttgacttttggttggctgggacta

SEQ ID NO: 972481 - DNA, 25 bp, Mus musculus
tttgactttttaccctttttcacat

SEQ ID NO: 972482 - DNA, 25 bp, Mus musculus
tttgactttttagcctttttcacat

SEQ ID NO: 972483 - DNA, 25 bp, Mus musculus
tttgacttttttccctgatggccaa

SEQ ID NO: 972484 - DNA, 25 bp, Mus musculus
tttgacttttttgcctgatggccaa

SEQ ID NO: 972485 - DNA, 25 bp, Mus musculus
tttgagaaaagtccctacagccctg

SEQ ID NO: 972486 - DNA, 25 bp, Mus musculus
tttgagaaaagtgcctacagccctg

SEQ ID NO: 972487 - DNA, 25 bp, Mus musculus
tttgagaaacccatcctctggctct

SEQ ID NO: 972488 - DNA, 25 bp, Mus musculus
tttgagaaacccttcctctggctct

SEQ ID NO: 972489 - DNA, 25 bp, Mus musculus
tttgagaaactgatccccgatgtgc

SEQ ID NO: 972490 - DNA, 25 bp, Mus musculus
tttgagaaactgttccccgatgtgc

SEQ ID NO: 972491 - DNA, 25 bp, Mus musculus
tttgagaaccatcaccgctgtctcg

SEQ ID NO: 972492 - DNA, 25 bp, Mus musculus
tttgagaaccatgaccgctgtctcg

SEQ ID NO: 972493 - DNA, 25 bp, Mus musculus
tttgagaaccgaactgactgctggg

SEQ ID NO: 972494 - DNA, 25 bp, Mus musculus
tttgagaaccgatctgactgctggg

SEQ ID NO: 972495 - DNA, 25 bp, Mus musculus
tttgagaacctccatctccgtggaa

SEQ ID NO: 972496 - DNA, 25 bp, Mus musculus
tttgagaacctcgatctccgtggaa

SEQ ID NO: 972497 - DNA, 25 bp, Mus musculus
tttgagaaccttctattgcccatat

SEQ ID NO: 972498 - DNA, 25 bp, Mus musculus
tttgagaaccttgtattgcccatat

SEQ ID NO: 972499 - DNA, 25 bp, Mus musculus
tttgagaacggcacttgctctatag

SEQ ID NO: 972500 - DNA, 25 bp, Mus musculus
tttgagaacggctcttgctctatag

SEQ ID NO: 972501 - DNA, 25 bp, Mus musculus
tttgagaacggtaacctggatggac

SEQ ID NO: 972502 - DNA, 25 bp, Mus musculus
tttgagaacggttacctggatggac

SEQ ID NO: 972503 - DNA, 25 bp, Mus musculus
tttgagaacgtcactcctgcagcat

SEQ ID NO: 972504 - DNA, 25 bp, Mus musculus
tttgagaacgtctctcctgcagcat

SEQ ID NO: 972505 - DNA, 25 bp, Mus musculus
tttgagaactagaatgacttatgtg

SEQ ID NO: 972506 - DNA, 25 bp, Mus musculus
tttgagaactagtatgacttatgtg

SEQ ID NO: 972507 - DNA, 25 bp, Mus musculus
tttgagaagccacgtgacccatgat

SEQ ID NO: 972508 - DNA, 25 bp, Mus musculus
tttgagaagccaggtgacccatgat

SEQ ID NO: 972509 - DNA, 25 bp, Mus musculus
tttgagaatcaaacctctgagaggc

SEQ ID NO: 972510 - DNA, 25 bp, Mus musculus
tttgagaatcaatcctctgagaggc

SEQ ID NO: 972511 - DNA, 25 bp, Mus musculus
tttgagaatgacagggcatgctagc

SEQ ID NO: 972512 - DNA, 25 bp, Mus musculus
tttgagaatgactgggcatgctagc

SEQ ID NO: 972513 - DNA, 25 bp, Mus musculus
tttgagacagtccatatgccaggtc

SEQ ID NO: 972514 - DNA, 25 bp, Mus musculus
tttgagacagtcgatatgccaggtc

SEQ ID NO: 972515 - DNA, 25 bp, Mus musculus
tttgagaccaacactgaaccagact

SEQ ID NO: 972516 - DNA, 25 bp, Mus musculus
tttgagaccaactctgaaccagact

SEQ ID NO: 972517 - DNA, 25 bp, Mus musculus
tttgagaccagcacgggatacatga

SEQ ID NO: 972518 - DNA, 25 bp, Mus musculus
tttgagaccagctcgggatacatga

SEQ ID NO: 972519 - DNA, 25 bp, Mus musculus
tttgagaccagtctgggcctcatgg

SEQ ID NO: 972520 - DNA, 25 bp, Mus musculus
tttgagaccagtgtgggcctcatgg

SEQ ID NO: 972521 - DNA, 25 bp, Mus musculus
tttgagacgcgtacttcactgtgca

SEQ ID NO: 972522 - DNA, 25 bp, Mus musculus
tttgagacgcgttcttcactgtgca

SEQ ID NO: 972523 - DNA, 25 bp, Mus musculus
tttgagactagcctgttgaacataa

SEQ ID NO: 972524 - DNA, 25 bp, Mus musculus
tttgagactagcgtgttgaacataa

SEQ ID NO: 972525 - DNA, 25 bp, Mus musculus
tttgagactatgctcaacccagagc

SEQ ID NO: 972526 - DNA, 25 bp, Mus musculus
tttgagactatggtcaacccagagc

SEQ ID NO: 972527 - DNA, 25 bp, Mus musculus
tttgagactctccaatgccagcctt

SEQ ID NO: 972528 - DNA, 25 bp, Mus musculus
tttgagactctcgaatgccagcctt

SEQ ID NO: 972529 - DNA, 25 bp, Mus musculus
tttgagactgctacccgatgtaccg

SEQ ID NO: 972530 - DNA, 25 bp, Mus musculus
tttgagactgcttcccgatgtaccg

SEQ ID NO: 972531 - DNA, 25 bp, Mus musculus
tttgagactgtaatccccagcatat

SEQ ID NO: 972532 - DNA, 25 bp, Mus musculus
tttgagactgtattccccagcatat

SEQ ID NO: 972533 - DNA, 25 bp, Mus musculus
tttgagagactgctccctccggaca

SEQ ID NO: 972534 - DNA, 25 bp, Mus musculus
tttgagagactggtccctccggaca

SEQ ID NO: 972535 - DNA, 25 bp, Mus musculus
tttgagagcaccattgcacttgtct

SEQ ID NO: 972536 - DNA, 25 bp, Mus musculus
tttgagagcacctttgcacttgtct

SEQ ID NO: 972537 - DNA, 25 bp, Mus musculus
tttgagagcatgaccctgggcagtt

SEQ ID NO: 972538 - DNA, 25 bp, Mus musculus
tttgagagcatgtccctgggcagtt

SEQ ID NO: 972539 - DNA, 25 bp, Mus musculus
tttgagagcctgcaaaccgggacct

SEQ ID NO: 972540 - DNA, 25 bp, Mus musculus
tttgagagcctggaaaccgggacct

SEQ ID NO: 972541 - DNA, 25 bp, Mus musculus
tttgagagctgcaccaaaagcaatg

SEQ ID NO: 972542 - DNA, 25 bp, Mus musculus
tttgagagctgctccaaaagcaatg

SEQ ID NO: 972543 - DNA, 25 bp, Mus musculus
tttgagagctgtaattcagacaacc

SEQ ID NO: 972544 - DNA, 25 bp, Mus musculus
tttgagagctgttattcagacaacc

SEQ ID NO: 972545 - DNA, 25 bp, Mus musculus
tttgagaggcacatatcactgtccc

SEQ ID NO: 972546 - DNA, 25 bp, Mus musculus
tttgagaggcacttatcactgtccc

SEQ ID NO: 972547 - DNA, 25 bp, Mus musculus
tttgagagttaacaattaccaggta

SEQ ID NO: 972548 - DNA, 25 bp, Mus musculus
tttgagagttaagaattaccaggta

SEQ ID NO: 972549 - DNA, 25 bp, Mus musculus
tttgagatccctatttaacagcttg

SEQ ID NO: 972550 - DNA, 25 bp, Mus musculus
tttgagatccctttttaacagcttg

SEQ ID NO: 972551 - DNA, 25 bp, Mus musculus
tttgagatcgctacctaccgcaggc

SEQ ID NO: 972552 - DNA, 25 bp, Mus musculus
tttgagatcgcttcctaccgcaggc

SEQ ID NO: 972553 - DNA, 25 bp, Mus musculus
tttgagatctgtagctgaccagccc

SEQ ID NO: 972554 - DNA, 25 bp, Mus musculus
tttgagatctgttgctgaccagccc

SEQ ID NO: 972555 - DNA, 25 bp, Mus musculus
tttgagatcttgactgtgtcgttct

SEQ ID NO: 972556 - DNA, 25 bp, Mus musculus
tttgagatcttgtctgtgtcgttct

SEQ ID NO: 972557 - DNA, 25 bp, Mus musculus
tttgagatgtgtactgtcacctctg

SEQ ID NO: 972558 - DNA, 25 bp, Mus musculus
tttgagatgtgttctgtcacctctg

SEQ ID NO: 972559 - DNA, 25 bp, Mus musculus
tttgagattaacaaggagcttggct

SEQ ID NO: 972560 - DNA, 25 bp, Mus musculus
tttgagattaactaggagcttggct

SEQ ID NO: 972561 - DNA, 25 bp, Mus musculus
tttgagattagcaaggtaacctgtg

SEQ ID NO: 972562 - DNA, 25 bp, Mus musculus
tttgagattagctaggtaacctgtg

SEQ ID NO: 972563 - DNA, 25 bp, Mus musculus
tttgagcaaagcaccatcttgggat

SEQ ID NO: 972564 - DNA, 25 bp, Mus musculus
tttgagcaaagctccatcttgggat

SEQ ID NO: 972565 - DNA, 25 bp, Mus musculus
tttgagcaaggccagtgaccacagt

SEQ ID NO: 972566 - DNA, 25 bp, Mus musculus
tttgagcaaggcgagtgaccacagt

SEQ ID NO: 972567 - DNA, 25 bp, Mus musculus
tttgagcacaggatccccaaggagc

SEQ ID NO: 972568 - DNA, 25 bp, Mus musculus
tttgagcacaggttccccaaggagc

SEQ ID NO: 972569 - DNA, 25 bp, Mus musculus
tttgagcacatcatccccaaggccc

SEQ ID NO: 972570 - DNA, 25 bp, Mus musculus
tttgagcacatcttccccaaggccc

SEQ ID NO: 972571 - DNA, 25 bp, Mus musculus
tttgagcaccctccaaattttggac

SEQ ID NO: 972572 - DNA, 25 bp, Mus musculus
tttgagcaccctgcaaattttggac

SEQ ID NO: 972573 - DNA, 25 bp, Mus musculus
tttgagcagagcatggtggtgtaca

SEQ ID NO: 972574 - DNA, 25 bp, Mus musculus
tttgagcagagcttggtggtgtaca

SEQ ID NO: 972575 - DNA, 25 bp, Mus musculus
tttgagcagcccatgcaactgtatt

SEQ ID NO: 972576 - DNA, 25 bp, Mus musculus
tttgagcagcccttgcaactgtatt

SEQ ID NO: 972577 - DNA, 25 bp, Mus musculus
tttgagcagctcctctgatgtggcc

SEQ ID NO: 972578 - DNA, 25 bp, Mus musculus
tttgagcagctcgtctgatgtggcc

SEQ ID NO: 972579 - DNA, 25 bp, Mus musculus
tttgagcaggctatcattttctcct

SEQ ID NO: 972580 - DNA, 25 bp, Mus musculus
tttgagcaggctttcattttctcct

SEQ ID NO: 972581 - DNA, 25 bp, Mus musculus
tttgagcagggcaacaccacctcca

SEQ ID NO: 972582 - DNA, 25 bp, Mus musculus
tttgagcagggctacaccacctcca

SEQ ID NO: 972583 - DNA, 25 bp, Mus musculus
tttgagcagttgagctgtttgcctg

SEQ ID NO: 972584 - DNA, 25 bp, Mus musculus
tttgagcagttgtgctgtttgcctg

SEQ ID NO: 972585 - DNA, 25 bp, Mus musculus
tttgagcatactaaggatacacgcc

SEQ ID NO: 972586 - DNA, 25 bp, Mus musculus
tttgagcatacttaggatacacgcc

SEQ ID NO: 972587 - DNA, 25 bp, Mus musculus
tttgagcatggtacgtgcttacctt

SEQ ID NO: 972588 - DNA, 25 bp, Mus musculus
tttgagcatggttcgtgcttacctt

SEQ ID NO: 972589 - DNA, 25 bp, Mus musculus
tttgagcatgtgactagcgagattg

SEQ ID NO: 972590 - DNA, 25 bp, Mus musculus
tttgagcatgtgtctagcgagattg

SEQ ID NO: 972591 - DNA, 25 bp, Mus musculus
tttgagccaaacataaccctgagcc

SEQ ID NO: 972592 - DNA, 25 bp, Mus musculus
tttgagccaaacctaggctgacctt

SEQ ID NO: 972593 - DNA, 25 bp, Mus musculus
tttgagccaaacgtaggctgacctt

SEQ ID NO: 972594 - DNA, 25 bp, Mus musculus
tttgagccaaacttaaccctgagcc

SEQ ID NO: 972595 - DNA, 25 bp, Mus musculus
tttgagccaagtactccagatcccg

SEQ ID NO: 972596 - DNA, 25 bp, Mus musculus
tttgagccaagttctccagatcccg

SEQ ID NO: 972597 - DNA, 25 bp, Mus musculus
tttgagccacacacataaagtcctg

SEQ ID NO: 972598 - DNA, 25 bp, Mus musculus
tttgagccacactcataaagtcctg

SEQ ID NO: 972599 - DNA, 25 bp, Mus musculus
tttgagccacatatcagcttaggaa

SEQ ID NO: 972600 - DNA, 25 bp, Mus musculus
tttgagccacatttcagcttaggaa

SEQ ID NO: 972601 - DNA, 25 bp, Mus musculus
tttgagccacccaactgtcatctct

SEQ ID NO: 972602 - DNA, 25 bp, Mus musculus
tttgagccaccctactgtcatctct

SEQ ID NO: 972603 - DNA, 25 bp, Mus musculus
tttgagccagatccctgagtcacag

SEQ ID NO: 972604 - DNA, 25 bp, Mus musculus
tttgagccagatgcctgagtcacag

SEQ ID NO: 972605 - DNA, 25 bp, Mus musculus
tttgagccaggcagtatatgcagtg

SEQ ID NO: 972606 - DNA, 25 bp, Mus musculus
tttgagccaggctgtatatgcagtg

SEQ ID NO: 972607 - DNA, 25 bp, Mus musculus
tttgagccatatctttcctccttta

SEQ ID NO: 972608 - DNA, 25 bp, Mus musculus
tttgagccatatgtttcctccttta

SEQ ID NO: 972609 - DNA, 25 bp, Mus musculus
tttgagcccaagactttatgtttgc

SEQ ID NO: 972610 - DNA, 25 bp, Mus musculus
tttgagcccaagtctttatgtttgc

SEQ ID NO: 972611 - DNA, 25 bp, Mus musculus
tttgagcccagtatgccctatatag

SEQ ID NO: 972612 - DNA, 25 bp, Mus musculus
tttgagcccagtttgccctatatag

SEQ ID NO: 972613 - DNA, 25 bp, Mus musculus
tttgagccccgtaggaaaggacact

SEQ ID NO: 972614 - DNA, 25 bp, Mus musculus
tttgagccccgttggaaaggacact

SEQ ID NO: 972615 - DNA, 25 bp, Mus musculus
tttgagccgccacgcagagatgcaa

SEQ ID NO: 972616 - DNA, 25 bp, Mus musculus
tttgagccgccaggcagagatgcaa

SEQ ID NO: 972617 - DNA, 25 bp, Mus musculus
tttgagcgcgccagaggccgaaggg

SEQ ID NO: 972618 - DNA, 25 bp, Mus musculus
tttgagcgcgcctgaggccgaaggg

SEQ ID NO: 972619 - DNA, 25 bp, Mus musculus
tttgagcgtctgacgtttggacgaa

SEQ ID NO: 972620 - DNA, 25 bp, Mus musculus
tttgagcgtctgtcgtttggacgaa

SEQ ID NO: 972621 - DNA, 25 bp, Mus musculus
tttgagctacaaaccccatgtgtgt

SEQ ID NO: 972622 - DNA, 25 bp, Mus musculus
tttgagctacaatccccatgtgtgt

SEQ ID NO: 972623 - DNA, 25 bp, Mus musculus
tttgagctactgcaacctccgtgga

SEQ ID NO: 972624 - DNA, 25 bp, Mus musculus
tttgagctactggaacctccgtgga

SEQ ID NO: 972625 - DNA, 25 bp, Mus musculus
tttgagctattgaccatcactgtag

SEQ ID NO: 972626 - DNA, 25 bp, Mus musculus
tttgagctattgtccatcactgtag

SEQ ID NO: 972627 - DNA, 25 bp, Mus musculus
tttgagctcagcaggctcccaaatg

SEQ ID NO: 972628 - DNA, 25 bp, Mus musculus
tttgagctcagctggctcccaaatg

SEQ ID NO: 972629 - DNA, 25 bp, Mus musculus
tttgagctcgccacaggagactatt

SEQ ID NO: 972630 - DNA, 25 bp, Mus musculus
tttgagctcgcctcaggagactatt

SEQ ID NO: 972631 - DNA, 25 bp, Mus musculus
tttgagctcggtctaaactttccct

SEQ ID NO: 972632 - DNA, 25 bp, Mus musculus
tttgagctcggtgtaaactttccct

SEQ ID NO: 972633 - DNA, 25 bp, Mus musculus
tttgagctcgtaccaacagacctga

SEQ ID NO: 972634 - DNA, 25 bp, Mus musculus
tttgagctcgtagcaacagacctga

SEQ ID NO: 972635 - DNA, 25 bp, Mus musculus
tttgagctctgacaacggacagact

SEQ ID NO: 972636 - DNA, 25 bp, Mus musculus
tttgagctctgagaacggacagact

SEQ ID NO: 972637 - DNA, 25 bp, Mus musculus
tttgagctcttaagactgtgtgcat

SEQ ID NO: 972638 - DNA, 25 bp, Mus musculus
tttgagctcttatgactgtgtgcat

SEQ ID NO: 972639 - DNA, 25 bp, Mus musculus
tttgagctgcacacagctctgaagt

SEQ ID NO: 972640 - DNA, 25 bp, Mus musculus
tttgagctgcactcagctctgaagt

SEQ ID NO: 972641 - DNA, 25 bp, Mus musculus
tttgagctgctcagccttgatggca

SEQ ID NO: 972642 - DNA, 25 bp, Mus musculus
tttgagctgctctgccttgatggca

SEQ ID NO: 972643 - DNA, 25 bp, Mus musculus
tttgagctgtgtattgggcagacca

SEQ ID NO: 972644 - DNA, 25 bp, Mus musculus
tttgagctgtgttttgggcagacca

SEQ ID NO: 972645 - DNA, 25 bp, Mus musculus
tttgagcttacaacacagacctggc

SEQ ID NO: 972646 - DNA, 25 bp, Mus musculus
tttgagcttacatcacagacctggc

SEQ ID NO: 972647 - DNA, 25 bp, Mus musculus
tttgagcttactcggccttaggaaa

SEQ ID NO: 972648 - DNA, 25 bp, Mus musculus
tttgagcttactgggccttaggaaa

SEQ ID NO: 972649 - DNA, 25 bp, Mus musculus
tttgagcttgtgagttcgcagaacc

SEQ ID NO: 972650 - DNA, 25 bp, Mus musculus
tttgagcttgtgtgttcgcagaacc

SEQ ID NO: 972651 - DNA, 25 bp, Mus musculus
tttgagctttatctgatttcctgaa

SEQ ID NO: 972652 - DNA, 25 bp, Mus musculus
tttgagctttatgtgatttcctgaa

SEQ ID NO: 972653 - DNA, 25 bp, Mus musculus
tttgaggaacaacctctccttatcc

SEQ ID NO: 972654 - DNA, 25 bp, Mus musculus
tttgaggaacaagctctccttatcc

SEQ ID NO: 972655 - DNA, 25 bp, Mus musculus
tttgaggaaccaagccagccacatt

SEQ ID NO: 972656 - DNA, 25 bp, Mus musculus
tttgaggaaccatgccagccacatt

SEQ ID NO: 972657 - DNA, 25 bp, Mus musculus
tttgaggaacggctcacagtgtcct

SEQ ID NO: 972658 - DNA, 25 bp, Mus musculus
tttgaggaacgggtcacagtgtcct

SEQ ID NO: 972659 - DNA, 25 bp, Mus musculus
tttgaggacaagacgggcaacctgc

SEQ ID NO: 972660 - DNA, 25 bp, Mus musculus
tttgaggacaagtcgggcaacctgc

SEQ ID NO: 972661 - DNA, 25 bp, Mus musculus
tttgaggacatgatcgccaaggccc

SEQ ID NO: 972662 - DNA, 25 bp, Mus musculus
tttgaggacatgttcgccaaggccc

SEQ ID NO: 972663 - DNA, 25 bp, Mus musculus
tttgaggactctatgggaccctact

SEQ ID NO: 972664 - DNA, 25 bp, Mus musculus
tttgaggactctttgggaccctact

SEQ ID NO: 972665 - DNA, 25 bp, Mus musculus
tttgaggactttctcttcggccact

SEQ ID NO: 972666 - DNA, 25 bp, Mus musculus
tttgaggactttgtcttcggccact

SEQ ID NO: 972667 - DNA, 25 bp, Mus musculus
tttgaggagacacaagcgcccgttg

SEQ ID NO: 972668 - DNA, 25 bp, Mus musculus
tttgaggagacagaagcgcccgttg

SEQ ID NO: 972669 - DNA, 25 bp, Mus musculus
tttgaggagcgaaacaagacaggga

SEQ ID NO: 972670 - DNA, 25 bp, Mus musculus
tttgaggagcgatacaagacaggga

SEQ ID NO: 972671 - DNA, 25 bp, Mus musculus
tttgaggatgccagccagcacacat

SEQ ID NO: 972672 - DNA, 25 bp, Mus musculus
tttgaggatgcctgccagcacacat

SEQ ID NO: 972673 - DNA, 25 bp, Mus musculus
tttgaggatggcatctgctgctaaa

SEQ ID NO: 972674 - DNA, 25 bp, Mus musculus
tttgaggatggcttctgctgctaaa

SEQ ID NO: 972675 - DNA, 25 bp, Mus musculus
tttgaggatgttacgttgccccgca

SEQ ID NO: 972676 - DNA, 25 bp, Mus musculus
tttgaggatgtttcgttgccccgca

SEQ ID NO: 972677 - DNA, 25 bp, Mus musculus
tttgaggcaaaaagaaggaaccgtg

SEQ ID NO: 972678 - DNA, 25 bp, Mus musculus
tttgaggcaaaatgaaggaaccgtg

SEQ ID NO: 972679 - DNA, 25 bp, Mus musculus
tttgaggcaaccactctgagggtga

SEQ ID NO: 972680 - DNA, 25 bp, Mus musculus
tttgaggcaacctctctgagggtga

SEQ ID NO: 972681 - DNA, 25 bp, Mus musculus
tttgaggcaagactcggactctgat

SEQ ID NO: 972682 - DNA, 25 bp, Mus musculus
tttgaggcaagagtcggactctgat

SEQ ID NO: 972683 - DNA, 25 bp, Mus musculus
tttgaggccagcatagggtctgtta

SEQ ID NO: 972684 - DNA, 25 bp, Mus musculus
tttgaggccagcttagggtctgtta

SEQ ID NO: 972685 - DNA, 25 bp, Mus musculus
tttgaggcccaccacttaaataagt

SEQ ID NO: 972686 - DNA, 25 bp, Mus musculus
tttgaggcccacgacttaaataagt

SEQ ID NO: 972687 - DNA, 25 bp, Mus musculus
tttgaggcccttagcaatgtgctgc

SEQ ID NO: 972688 - DNA, 25 bp, Mus musculus
tttgaggccctttgcaatgtgctgc

SEQ ID NO: 972689 - DNA, 25 bp, Mus musculus
tttgaggcgaccaacctggagctgg

SEQ ID NO: 972690 - DNA, 25 bp, Mus musculus
tttgaggcgacctacctggagctgg

SEQ ID NO: 972691 - DNA, 25 bp, Mus musculus
tttgaggctcacatgatctagtttt

SEQ ID NO: 972692 - DNA, 25 bp, Mus musculus
tttgaggctcacttgatctagtttt

SEQ ID NO: 972693 - DNA, 25 bp, Mus musculus
tttgaggctgaccaagtgagcccct

SEQ ID NO: 972694 - DNA, 25 bp, Mus musculus
tttgaggctgacgaagtgagcccct

SEQ ID NO: 972695 - DNA, 25 bp, Mus musculus
tttgaggctggtcttttgcaccctt

SEQ ID NO: 972696 - DNA, 25 bp, Mus musculus
tttgaggctggtgttttgcaccctt

SEQ ID NO: 972697 - DNA, 25 bp, Mus musculus
tttgaggctgtactccacacggtat

SEQ ID NO: 972698 - DNA, 25 bp, Mus musculus
tttgaggctgtagtccacacggtat

SEQ ID NO: 972699 - DNA, 25 bp, Mus musculus
tttgaggcttttcagagctcctgac

SEQ ID NO: 972700 - DNA, 25 bp, Mus musculus
tttgaggcttttgagagctcctgac

SEQ ID NO: 972701 - DNA, 25 bp, Mus musculus
tttgagggcctaattatgttctgaa

SEQ ID NO: 972702 - DNA, 25 bp, Mus musculus
tttgagggcctatttatgttctgaa

SEQ ID NO: 972703 - DNA, 25 bp, Mus musculus
tttgagggcgacagactgcgcctca

SEQ ID NO: 972704 - DNA, 25 bp, Mus musculus
tttgagggcgactgactgcgcctca

SEQ ID NO: 972705 - DNA, 25 bp, Mus musculus
tttgagggctccagttgcttgcctc

SEQ ID NO: 972706 - DNA, 25 bp, Mus musculus
tttgagggctcctgttgcttgcctc

SEQ ID NO: 972707 - DNA, 25 bp, Mus musculus
tttgagggctttctgatgcactgct

SEQ ID NO: 972708 - DNA, 25 bp, Mus musculus
tttgagggctttgtgatgcactgct

SEQ ID NO: 972709 - DNA, 25 bp, Mus musculus
tttgaggtaactaccccacaacact

SEQ ID NO: 972710 - DNA, 25 bp, Mus musculus
tttgaggtaacttccccacaacact

SEQ ID NO: 972711 - DNA, 25 bp, Mus musculus
tttgaggtcccacatcagccagggc

SEQ ID NO: 972712 - DNA, 25 bp, Mus musculus
tttgaggtcccagatcagccagggc

SEQ ID NO: 972713 - DNA, 25 bp, Mus musculus
tttgaggtctcaacatcatggttct

SEQ ID NO: 972714 - DNA, 25 bp, Mus musculus
tttgaggtctcatcatcatggttct

SEQ ID NO: 972715 - DNA, 25 bp, Mus musculus
tttgaggtctgaagctgtagcccat

SEQ ID NO: 972716 - DNA, 25 bp, Mus musculus
tttgaggtctgatgctgtagcccat

SEQ ID NO: 972717 - DNA, 25 bp, Mus musculus
tttgaggtggctatttggagcaaac

SEQ ID NO: 972718 - DNA, 25 bp, Mus musculus
tttgaggtggctttttggagcaaac

SEQ ID NO: 972719 - DNA, 25 bp, Mus musculus
tttgaggtgtccataaaagcaggta

SEQ ID NO: 972720 - DNA, 25 bp, Mus musculus
tttgaggtgtccttaaaagcaggta

SEQ ID NO: 972721 - DNA, 25 bp, Mus musculus
tttgagtcaaacagctatcttcgtt

SEQ ID NO: 972722 - DNA, 25 bp, Mus musculus
tttgagtcaaactgctatcttcgtt

SEQ ID NO: 972723 - DNA, 25 bp, Mus musculus
tttgagtcaaagacagcgaagtccc

SEQ ID NO: 972724 - DNA, 25 bp, Mus musculus
tttgagtcaaagtcagcgaagtccc

SEQ ID NO: 972725 - DNA, 25 bp, Mus musculus
tttgagtcagacattctggctgtcc

SEQ ID NO: 972726 - DNA, 25 bp, Mus musculus
tttgagtcagactttctggctgtcc

SEQ ID NO: 972727 - DNA, 25 bp, Mus musculus
tttgagtcagctaggaacattttgc

SEQ ID NO: 972728 - DNA, 25 bp, Mus musculus
tttgagtcagctccctgtccaggat

SEQ ID NO: 972729 - DNA, 25 bp, Mus musculus
tttgagtcagctgcctgtccaggat

SEQ ID NO: 972730 - DNA, 25 bp, Mus musculus
tttgagtcagcttggaacattttgc

SEQ ID NO: 972731 - DNA, 25 bp, Mus musculus
tttgagtcccttcgttctttttctg

SEQ ID NO: 972732 - DNA, 25 bp, Mus musculus
tttgagtcccttggttctttttctg

SEQ ID NO: 972733 - DNA, 25 bp, Mus musculus
tttgagtctctcatggtatacaact

SEQ ID NO: 972734 - DNA, 25 bp, Mus musculus
tttgagtctctcttggtatacaact

SEQ ID NO: 972735 - DNA, 25 bp, Mus musculus
tttgagtctgctctcagagaacccc

SEQ ID NO: 972736 - DNA, 25 bp, Mus musculus
tttgagtctgctgtcagagaacccc

SEQ ID NO: 972737 - DNA, 25 bp, Mus musculus
tttgagtcttccctgactacctaaa

SEQ ID NO: 972738 - DNA, 25 bp, Mus musculus
tttgagtcttccgtgactacctaaa

SEQ ID NO: 972739 - DNA, 25 bp, Mus musculus
tttgagtctttcctatttctgttcc

SEQ ID NO: 972740 - DNA, 25 bp, Mus musculus
tttgagtctttcgtatttctgttcc

SEQ ID NO: 972741 - DNA, 25 bp, Mus musculus
tttgagtgcaaaactgtactagcca

SEQ ID NO: 972742 - DNA, 25 bp, Mus musculus
tttgagtgcaaatctgtactagcca

SEQ ID NO: 972743 - DNA, 25 bp, Mus musculus
tttgagtgccataatttttgtaaat

SEQ ID NO: 972744 - DNA, 25 bp, Mus musculus
tttgagtgccattatttttgtaaat

SEQ ID NO: 972745 - DNA, 25 bp, Mus musculus
tttgagtgcccgctggatccaagct

SEQ ID NO: 972746 - DNA, 25 bp, Mus musculus
tttgagtgcccggtggatccaagct

SEQ ID NO: 972747 - DNA, 25 bp, Mus musculus
tttgagtgctgtatcctttttagga

SEQ ID NO: 972748 - DNA, 25 bp, Mus musculus
tttgagtgctgtttcctttttagga

SEQ ID NO: 972749 - DNA, 25 bp, Mus musculus
tttgagtgtaggaactgtccagcag

SEQ ID NO: 972750 - DNA, 25 bp, Mus musculus
tttgagtgtaggtactgtccagcag

SEQ ID NO: 972751 - DNA, 25 bp, Mus musculus
tttgagtgttttcagaccaccctcc

SEQ ID NO: 972752 - DNA, 25 bp, Mus musculus
tttgagtgttttgagaccaccctcc

SEQ ID NO: 972753 - DNA, 25 bp, Mus musculus
tttgagttatatagttcctgtccca

SEQ ID NO: 972754 - DNA, 25 bp, Mus musculus
tttgagttatattgttcctgtccca

SEQ ID NO: 972755 - DNA, 25 bp, Mus musculus
tttgagttcacgatggatcctttct

SEQ ID NO: 972756 - DNA, 25 bp, Mus musculus
tttgagttcacgttggatcctttct

SEQ ID NO: 972757 - DNA, 25 bp, Mus musculus
tttgagttcccactcaatacctctc

SEQ ID NO: 972758 - DNA, 25 bp, Mus musculus
tttgagttcccagtcaatacctctc

SEQ ID NO: 972759 - DNA, 25 bp, Mus musculus
tttgagttctcacctaatagtcatt

SEQ ID NO: 972760 - DNA, 25 bp, Mus musculus
tttgagttctcagctaatagtcatt

SEQ ID NO: 972761 - DNA, 25 bp, Mus musculus
tttgagttcttacatcagagcgtcc

SEQ ID NO: 972762 - DNA, 25 bp, Mus musculus
tttgagttcttagatcagagcgtcc

SEQ ID NO: 972763 - DNA, 25 bp, Mus musculus
tttgagttgctcagtgtttgtcttc

SEQ ID NO: 972764 - DNA, 25 bp, Mus musculus
tttgagttgctctgtgtttgtcttc

SEQ ID NO: 972765 - DNA, 25 bp, Mus musculus
tttgagttgttcaatcaccctgccc

SEQ ID NO: 972766 - DNA, 25 bp, Mus musculus
tttgagttgttctatcaccctgccc

SEQ ID NO: 972767 - DNA, 25 bp, Mus musculus
tttgagtttctgcttctgactgcct

SEQ ID NO: 972768 - DNA, 25 bp, Mus musculus
tttgagtttctggttctgactgcct

SEQ ID NO: 972769 - DNA, 25 bp, Mus musculus
tttgagtttgagcttcagaggccac

SEQ ID NO: 972770 - DNA, 25 bp, Mus musculus
tttgagtttgaggttcagaggccac

SEQ ID NO: 972771 - DNA, 25 bp, Mus musculus
tttgagtttttcacttcccacaact

SEQ ID NO: 972772 - DNA, 25 bp, Mus musculus
tttgagtttttctcttcccacaact

SEQ ID NO: 972773 - DNA, 25 bp, Mus musculus
tttgataaatctctcatttgatgac

SEQ ID NO: 972774 - DNA, 25 bp, Mus musculus
tttgataaatctgtcatttgatgac

SEQ ID NO: 972775 - DNA, 25 bp, Mus musculus
tttgataaccaaaccatctggcccc

SEQ ID NO: 972776 - DNA, 25 bp, Mus musculus
tttgataaccaatccatctggcccc

SEQ ID NO: 972777 - DNA, 25 bp, Mus musculus
tttgataacccactagacctttcca

SEQ ID NO: 972778 - DNA, 25 bp, Mus musculus
tttgataacccagtagacctttcca

SEQ ID NO: 972779 - DNA, 25 bp, Mus musculus
tttgataactcgaatccatcccagt

SEQ ID NO: 972780 - DNA, 25 bp, Mus musculus
tttgataactcgtatccatcccagt

SEQ ID NO: 972781 - DNA, 25 bp, Mus musculus
tttgatactgataacatgtgccatt

SEQ ID NO: 972782 - DNA, 25 bp, Mus musculus
tttgatactgattacatgtgccatt

SEQ ID NO: 972783 - DNA, 25 bp, Mus musculus
tttgatactgtgagcgacgtggaga

SEQ ID NO: 972784 - DNA, 25 bp, Mus musculus
tttgatactgtgtgcgacgtggaga

SEQ ID NO: 972785 - DNA, 25 bp, Mus musculus
tttgatagatgccttgatttccatt

SEQ ID NO: 972786 - DNA, 25 bp, Mus musculus
tttgatagatgcgttgatttccatt

SEQ ID NO: 972787 - DNA, 25 bp, Mus musculus
tttgatagccatatcagatacatct

SEQ ID NO: 972788 - DNA, 25 bp, Mus musculus
tttgatagccatttcagatacatct

SEQ ID NO: 972789 - DNA, 25 bp, Mus musculus
tttgatagtaccatgggcctctgtt

SEQ ID NO: 972790 - DNA, 25 bp, Mus musculus
tttgatagtaccttgggcctctgtt

SEQ ID NO: 972791 - DNA, 25 bp, Mus musculus
tttgatagtatacataagtggccct

SEQ ID NO: 972792 - DNA, 25 bp, Mus musculus
tttgatagtatagataagtggccct

SEQ ID NO: 972793 - DNA, 25 bp, Mus musculus
tttgatataaacaagggaatgctgt

SEQ ID NO: 972794 - DNA, 25 bp, Mus musculus
tttgatataaactagggaatgctgt

SEQ ID NO: 972795 - DNA, 25 bp, Mus musculus
tttgatatacaaccacatcacacac

SEQ ID NO: 972796 - DNA, 25 bp, Mus musculus
tttgatatacaagcacatcacacac

SEQ ID NO: 972797 - DNA, 25 bp, Mus musculus
tttgatatagcacctcctttgcaca

SEQ ID NO: 972798 - DNA, 25 bp, Mus musculus
tttgatatagcagctcctttgcaca

SEQ ID NO: 972799 - DNA, 25 bp, Mus musculus
tttgatatccagcattgccccaaac

SEQ ID NO: 972800 - DNA, 25 bp, Mus musculus
tttgatatccaggattgccccaaac

SEQ ID NO: 972801 - DNA, 25 bp, Mus musculus
tttgatatgcaaagtccttgacctt

SEQ ID NO: 972802 - DNA, 25 bp, Mus musculus
tttgatatgcaatgtccttgacctt

SEQ ID NO: 972803 - DNA, 25 bp, Mus musculus
tttgatatgcagcatggtcttgggt

SEQ ID NO: 972804 - DNA, 25 bp, Mus musculus
tttgatatgcaggatggtcttgggt

SEQ ID NO: 972805 - DNA, 25 bp, Mus musculus
tttgatattatacatgggaagcatt

SEQ ID NO: 972806 - DNA, 25 bp, Mus musculus
tttgatattatagatgggaagcatt

SEQ ID NO: 972807 - DNA, 25 bp, Mus musculus
tttgatattatgatactttccctgg

SEQ ID NO: 972808 - DNA, 25 bp, Mus musculus
tttgatattatgttactttccctgg

SEQ ID NO: 972809 - DNA, 25 bp, Mus musculus
tttgatatttatatcctgctactga

SEQ ID NO: 972810 - DNA, 25 bp, Mus musculus
tttgatatttatttcctgctactga

SEQ ID NO: 972811 - DNA, 25 bp, Mus musculus
tttgatcaacagattccattctctt

SEQ ID NO: 972812 - DNA, 25 bp, Mus musculus
tttgatcaacagtttccattctctt

SEQ ID NO: 972813 - DNA, 25 bp, Mus musculus
tttgatcacactcaatacccaccta

SEQ ID NO: 972814 - DNA, 25 bp, Mus musculus
tttgatcacactgaatacccaccta

SEQ ID NO: 972815 - DNA, 25 bp, Mus musculus
tttgatcacttacctgcctgtctcc

SEQ ID NO: 972816 - DNA, 25 bp, Mus musculus
tttgatcacttagctgcctgtctcc

SEQ ID NO: 972817 - DNA, 25 bp, Mus musculus
tttgatcagaccctcccaaccagat

SEQ ID NO: 972818 - DNA, 25 bp, Mus musculus
tttgatcagaccgtcccaaccagat

SEQ ID NO: 972819 - DNA, 25 bp, Mus musculus
tttgatcagccaaggttttctgtaa

SEQ ID NO: 972820 - DNA, 25 bp, Mus musculus
tttgatcagccatggttttctgtaa

SEQ ID NO: 972821 - DNA, 25 bp, Mus musculus
tttgatcaggtgatgtcattgacat

SEQ ID NO: 972822 - DNA, 25 bp, Mus musculus
tttgatcaggtgttgtcattgacat

SEQ ID NO: 972823 - DNA, 25 bp, Mus musculus
tttgatcagttcaacgaggcggcgc

SEQ ID NO: 972824 - DNA, 25 bp, Mus musculus
tttgatcagttctacgaggcggcgc

SEQ ID NO: 972825 - DNA, 25 bp, Mus musculus
tttgatcataccatgcaatcgcaga

SEQ ID NO: 972826 - DNA, 25 bp, Mus musculus
tttgatcataccttgcaatcgcaga

SEQ ID NO: 972827 - DNA, 25 bp, Mus musculus
tttgatccaataattcctcactatg

SEQ ID NO: 972828 - DNA, 25 bp, Mus musculus
tttgatccaatatttcctcactatg

SEQ ID NO: 972829 - DNA, 25 bp, Mus musculus
tttgatccagcgagtaattacggga

SEQ ID NO: 972830 - DNA, 25 bp, Mus musculus
tttgatccagcgtgtaattacggga

SEQ ID NO: 972831 - DNA, 25 bp, Mus musculus
tttgatccaggtacccaggaagcag

SEQ ID NO: 972832 - DNA, 25 bp, Mus musculus
tttgatccaggttcccaggaagcag

SEQ ID NO: 972833 - DNA, 25 bp, Mus musculus
tttgatccccagcaaacgatggaag

SEQ ID NO: 972834 - DNA, 25 bp, Mus musculus
tttgatccccaggaaacgatggaag

SEQ ID NO: 972835 - DNA, 25 bp, Mus musculus
tttgatcccctacagttggaggtat

SEQ ID NO: 972836 - DNA, 25 bp, Mus musculus
tttgatcccctagagttggaggtat

SEQ ID NO: 972837 - DNA, 25 bp, Mus musculus
tttgatcccctgagggtttgttaag

SEQ ID NO: 972838 - DNA, 25 bp, Mus musculus
tttgatcccctgtgggtttgttaag

SEQ ID NO: 972839 - DNA, 25 bp, Mus musculus
tttgatccggccacggattggatgg

SEQ ID NO: 972840 - DNA, 25 bp, Mus musculus
tttgatccggcctcggattggatgg

SEQ ID NO: 972841 - DNA, 25 bp, Mus musculus
tttgatcctgagaggccgcctaaac

SEQ ID NO: 972842 - DNA, 25 bp, Mus musculus
tttgatcctgagtggccgcctaaac

SEQ ID NO: 972843 - DNA, 25 bp, Mus musculus
tttgatcgctacattgccatctgta

SEQ ID NO: 972844 - DNA, 25 bp, Mus musculus
tttgatcgctactttgccatctgta

SEQ ID NO: 972845 - DNA, 25 bp, Mus musculus
tttgatcgtctgcaccaacgagttt

SEQ ID NO: 972846 - DNA, 25 bp, Mus musculus
tttgatcgtctggaccaacgagttt

SEQ ID NO: 972847 - DNA, 25 bp, Mus musculus
tttgatctcaccacgctgttatatc

SEQ ID NO: 972848 - DNA, 25 bp, Mus musculus
tttgatctcacctcgctgttatatc

SEQ ID NO: 972849 - DNA, 25 bp, Mus musculus
tttgatctccatcgctcaagacccg

SEQ ID NO: 972850 - DNA, 25 bp, Mus musculus
tttgatctccatggctcaagacccg

SEQ ID NO: 972851 - DNA, 25 bp, Mus musculus
tttgatctgacaatgactctagcct

SEQ ID NO: 972852 - DNA, 25 bp, Mus musculus
tttgatctgacattgactctagcct

SEQ ID NO: 972853 - DNA, 25 bp, Mus musculus
tttgatctggagacagcccatcctt

SEQ ID NO: 972854 - DNA, 25 bp, Mus musculus
tttgatctggagtcagcccatcctt

SEQ ID NO: 972855 - DNA, 25 bp, Mus musculus
tttgatctggataacacgctctggc

SEQ ID NO: 972856 - DNA, 25 bp, Mus musculus
tttgatctggattacacgctctggc

SEQ ID NO: 972857 - DNA, 25 bp, Mus musculus
tttgatctgtccctccaggcttctc

SEQ ID NO: 972858 - DNA, 25 bp, Mus musculus
tttgatctgtccgtccaggcttctc

SEQ ID NO: 972859 - DNA, 25 bp, Mus musculus
tttgatcttctgcttccataacacg

SEQ ID NO: 972860 - DNA, 25 bp, Mus musculus
tttgatcttctggttccataacacg

SEQ ID NO: 972861 - DNA, 25 bp, Mus musculus
tttgatcttcttagttgaacatctg

SEQ ID NO: 972862 - DNA, 25 bp, Mus musculus
tttgatcttctttgttgaacatctg

SEQ ID NO: 972863 - DNA, 25 bp, Mus musculus
tttgatcttgacacgaaactgccag

SEQ ID NO: 972864 - DNA, 25 bp, Mus musculus
tttgatcttgaccactcatggaagc

SEQ ID NO: 972865 - DNA, 25 bp, Mus musculus
tttgatcttgacgactcatggaagc

SEQ ID NO: 972866 - DNA, 25 bp, Mus musculus
tttgatcttgactcgaaactgccag

SEQ ID NO: 972867 - DNA, 25 bp, Mus musculus
tttgatcttgcccagcctctaggat

SEQ ID NO: 972868 - DNA, 25 bp, Mus musculus
tttgatcttgccgagcctctaggat

SEQ ID NO: 972869 - DNA, 25 bp, Mus musculus
tttgatcttttgacactgagcccaa

SEQ ID NO: 972870 - DNA, 25 bp, Mus musculus
tttgatcttttgtcactgagcccaa

SEQ ID NO: 972871 - DNA, 25 bp, Mus musculus
tttgatgaccttcccggactgtggt

SEQ ID NO: 972872 - DNA, 25 bp, Mus musculus
tttgatgaccttgccggactgtggt

SEQ ID NO: 972873 - DNA, 25 bp, Mus musculus
tttgatgacgagatcaccgcccagt

SEQ ID NO: 972874 - DNA, 25 bp, Mus musculus
tttgatgacgagttcaccgcccagt

SEQ ID NO: 972875 - DNA, 25 bp, Mus musculus
tttgatgacggaaaggaattgccta

SEQ ID NO: 972876 - DNA, 25 bp, Mus musculus
tttgatgacggataggaattgccta

SEQ ID NO: 972877 - DNA, 25 bp, Mus musculus
tttgatgagtccctttccctgtggt

SEQ ID NO: 972878 - DNA, 25 bp, Mus musculus
tttgatgagtccgtttccctgtggt

SEQ ID NO: 972879 - DNA, 25 bp, Mus musculus
tttgatgagtgtactatcacccaca

SEQ ID NO: 972880 - DNA, 25 bp, Mus musculus
tttgatgagtgttctatcacccaca

SEQ ID NO: 972881 - DNA, 25 bp, Mus musculus
tttgatgatcatacctgcagcagct

SEQ ID NO: 972882 - DNA, 25 bp, Mus musculus
tttgatgatcattcctgcagcagct

SEQ ID NO: 972883 - DNA, 25 bp, Mus musculus
tttgatgattttcggctcggccggc

SEQ ID NO: 972884 - DNA, 25 bp, Mus musculus
tttgatgattttgggctcggccggc

SEQ ID NO: 972885 - DNA, 25 bp, Mus musculus
tttgatgcaacacatgcactttgtg

SEQ ID NO: 972886 - DNA, 25 bp, Mus musculus
tttgatgcaacagatgcactttgtg

SEQ ID NO: 972887 - DNA, 25 bp, Mus musculus
tttgatgcaactactgtctaaattg

SEQ ID NO: 972888 - DNA, 25 bp, Mus musculus
tttgatgcaacttctgtctaaattg

SEQ ID NO: 972889 - DNA, 25 bp, Mus musculus
tttgatgcaatgacttggccttcag

SEQ ID NO: 972890 - DNA, 25 bp, Mus musculus
tttgatgcaatgtcttggccttcag

SEQ ID NO: 972891 - DNA, 25 bp, Mus musculus
tttgatgcacacactgccaagggag

SEQ ID NO: 972892 - DNA, 25 bp, Mus musculus
tttgatgcacactctgccaagggag

SEQ ID NO: 972893 - DNA, 25 bp, Mus musculus
tttgatgcagagatggtacaggacc

SEQ ID NO: 972894 - DNA, 25 bp, Mus musculus
tttgatgcagagttggtacaggacc

SEQ ID NO: 972895 - DNA, 25 bp, Mus musculus
tttgatgcatagatgagatacccac

SEQ ID NO: 972896 - DNA, 25 bp, Mus musculus
tttgatgcatagttgagatacccac

SEQ ID NO: 972897 - DNA, 25 bp, Mus musculus
tttgatgcatctcacactctagctt

SEQ ID NO: 972898 - DNA, 25 bp, Mus musculus
tttgatgcatctgacactctagctt

SEQ ID NO: 972899 - DNA, 25 bp, Mus musculus
tttgatgccacccaggaagtaccct

SEQ ID NO: 972900 - DNA, 25 bp, Mus musculus
tttgatgccaccgaggaagtaccct

SEQ ID NO: 972901 - DNA, 25 bp, Mus musculus
tttgatgccatcacgggttgaaatc

SEQ ID NO: 972902 - DNA, 25 bp, Mus musculus
tttgatgccatctcgggttgaaatc

SEQ ID NO: 972903 - DNA, 25 bp, Mus musculus
tttgatgccccgagaccacaggtgg

SEQ ID NO: 972904 - DNA, 25 bp, Mus musculus
tttgatgccccgtgaccacaggtgg

SEQ ID NO: 972905 - DNA, 25 bp, Mus musculus
tttgatgctgcaactctgatctgaa

SEQ ID NO: 972906 - DNA, 25 bp, Mus musculus
tttgatgctgcactgtggcctcact

SEQ ID NO: 972907 - DNA, 25 bp, Mus musculus
tttgatgctgcagtgtggcctcact

SEQ ID NO: 972908 - DNA, 25 bp, Mus musculus
tttgatgctgcatctctgatctgaa

SEQ ID NO: 972909 - DNA, 25 bp, Mus musculus
tttgatgctgcgcagggtcacccag

SEQ ID NO: 972910 - DNA, 25 bp, Mus musculus
tttgatgctgcggagggtcacccag

SEQ ID NO: 972911 - DNA, 25 bp, Mus musculus
tttgatgctgttctcgcaaggcaca

SEQ ID NO: 972912 - DNA, 25 bp, Mus musculus
tttgatgctgttgtcgcaaggcaca

SEQ ID NO: 972913 - DNA, 25 bp, Mus musculus
tttgatggagctcactgggtttgat

SEQ ID NO: 972914 - DNA, 25 bp, Mus musculus
tttgatggagctgactgggtttgat

SEQ ID NO: 972915 - DNA, 25 bp, Mus musculus
tttgatggcaaacgtcagctggaac

SEQ ID NO: 972916 - DNA, 25 bp, Mus musculus
tttgatggcaaaggtcagctggaac

SEQ ID NO: 972917 - DNA, 25 bp, Mus musculus
tttgatggcgtgatacttgctgtcc

SEQ ID NO: 972918 - DNA, 25 bp, Mus musculus
tttgatggcgtgttacttgctgtcc

SEQ ID NO: 972919 - DNA, 25 bp, Mus musculus
tttgatgggaacacgattatgatga

SEQ ID NO: 972920 - DNA, 25 bp, Mus musculus
tttgatgggaactcgattatgatga

SEQ ID NO: 972921 - DNA, 25 bp, Mus musculus
tttgatgtatatatcctctggcccc

SEQ ID NO: 972922 - DNA, 25 bp, Mus musculus
tttgatgtatatttcctctggcccc

SEQ ID NO: 972923 - DNA, 25 bp, Mus musculus
tttgatgtcacccagaggcgtgtac

SEQ ID NO: 972924 - DNA, 25 bp, Mus musculus
tttgatgtcaccgagaggcgtgtac

SEQ ID NO: 972925 - DNA, 25 bp, Mus musculus
tttgatgtccacaatgaggcaaatg

SEQ ID NO: 972926 - DNA, 25 bp, Mus musculus
tttgatgtccactatgaggcaaatg

SEQ ID NO: 972927 - DNA, 25 bp, Mus musculus
tttgatgtcccacagcttatcaggg

SEQ ID NO: 972928 - DNA, 25 bp, Mus musculus
tttgatgtcccagagcttatcaggg

SEQ ID NO: 972929 - DNA, 25 bp, Mus musculus
tttgatgtggttagcctgatctcta

SEQ ID NO: 972930 - DNA, 25 bp, Mus musculus
tttgatgtggtttgcctgatctcta

SEQ ID NO: 972931 - DNA, 25 bp, Mus musculus
tttgatgtttgtcttccacctctat

SEQ ID NO: 972932 - DNA, 25 bp, Mus musculus
tttgatgtttgtgttccacctctat

SEQ ID NO: 972933 - DNA, 25 bp, Mus musculus
tttgattaaacgctacctggactga

SEQ ID NO: 972934 - DNA, 25 bp, Mus musculus
tttgattaaacggtacctggactga

SEQ ID NO: 972935 - DNA, 25 bp, Mus musculus
tttgattaaataagtcctcctttgt

SEQ ID NO: 972936 - DNA, 25 bp, Mus musculus
tttgattaaatatgtcctcctttgt

SEQ ID NO: 972937 - DNA, 25 bp, Mus musculus
tttgattaagccctctaccatgact

SEQ ID NO: 972938 - DNA, 25 bp, Mus musculus
tttgattaagccgtctaccatgact

SEQ ID NO: 972939 - DNA, 25 bp, Mus musculus
tttgattaatggcttggctgggttt

SEQ ID NO: 972940 - DNA, 25 bp, Mus musculus
tttgattaatgggttggctgggttt

SEQ ID NO: 972941 - DNA, 25 bp, Mus musculus
tttgattacacaaccttctctaacc

SEQ ID NO: 972942 - DNA, 25 bp, Mus musculus
tttgattacacatccttctctaacc

SEQ ID NO: 972943 - DNA, 25 bp, Mus musculus
tttgattatgaacatgccggttacc

SEQ ID NO: 972944 - DNA, 25 bp, Mus musculus
tttgattatgaagatgccggttacc

SEQ ID NO: 972945 - DNA, 25 bp, Mus musculus
tttgattatgtcacctgtctctggg

SEQ ID NO: 972946 - DNA, 25 bp, Mus musculus
tttgattatgtctcctgtctctggg

SEQ ID NO: 972947 - DNA, 25 bp, Mus musculus
tttgattatttcacctgttctaaaa

SEQ ID NO: 972948 - DNA, 25 bp, Mus musculus
tttgattatttctcctgttctaaaa

SEQ ID NO: 972949 - DNA, 25 bp, Mus musculus
tttgattcagctactgtagcctcca

SEQ ID NO: 972950 - DNA, 25 bp, Mus musculus
tttgattcagcttctgtagcctcca

SEQ ID NO: 972951 - DNA, 25 bp, Mus musculus
tttgattcccagaagcttatattat

SEQ ID NO: 972952 - DNA, 25 bp, Mus musculus
tttgattcccagtagcttatattat

SEQ ID NO: 972953 - DNA, 25 bp, Mus musculus
tttgattcccatatgctctgcaaca

SEQ ID NO: 972954 - DNA, 25 bp, Mus musculus
tttgattcccatttgctctgcaaca

SEQ ID NO: 972955 - DNA, 25 bp, Mus musculus
tttgattcctcgaactccagacccc

SEQ ID NO: 972956 - DNA, 25 bp, Mus musculus
tttgattcctcgtactccagacccc

SEQ ID NO: 972957 - DNA, 25 bp, Mus musculus
tttgattcctggcatgaaccggttt

SEQ ID NO: 972958 - DNA, 25 bp, Mus musculus
tttgattcctgggatgaaccggttt

SEQ ID NO: 972959 - DNA, 25 bp, Mus musculus
tttgattctcctacacggtgggttc

SEQ ID NO: 972960 - DNA, 25 bp, Mus musculus
tttgattctccttcacggtgggttc

SEQ ID NO: 972961 - DNA, 25 bp, Mus musculus
tttgattctggcactatatttttcc

SEQ ID NO: 972962 - DNA, 25 bp, Mus musculus
tttgattctggctctatatttttcc

SEQ ID NO: 972963 - DNA, 25 bp, Mus musculus
tttgattctgttcccatttgtgtaa

SEQ ID NO: 972964 - DNA, 25 bp, Mus musculus
tttgattctgttgccatttgtgtaa

SEQ ID NO: 972965 - DNA, 25 bp, Mus musculus
tttgattgaaagctctggattccta

SEQ ID NO: 972966 - DNA, 25 bp, Mus musculus
tttgattgaaaggtctggattccta

SEQ ID NO: 972967 - DNA, 25 bp, Mus musculus
tttgattgacctactatgcttatgt

SEQ ID NO: 972968 - DNA, 25 bp, Mus musculus
tttgattgacctccagttgcggtgc

SEQ ID NO: 972969 - DNA, 25 bp, Mus musculus
tttgattgacctgcagttgcggtgc

SEQ ID NO: 972970 - DNA, 25 bp, Mus musculus
tttgattgaccttctatgcttatgt

SEQ ID NO: 972971 - DNA, 25 bp, Mus musculus
tttgattgcagccacagttacctct

SEQ ID NO: 972972 - DNA, 25 bp, Mus musculus
tttgattgcagcgacagttacctct

SEQ ID NO: 972973 - DNA, 25 bp, Mus musculus
tttgattgctatacatcagccagtt

SEQ ID NO: 972974 - DNA, 25 bp, Mus musculus
tttgattgctattcatcagccagtt

SEQ ID NO: 972975 - DNA, 25 bp, Mus musculus
tttgattggttgacacttcccacaa

SEQ ID NO: 972976 - DNA, 25 bp, Mus musculus
tttgattggttgtcacttcccacaa

SEQ ID NO: 972977 - DNA, 25 bp, Mus musculus
tttgatttaagcacgggcctctttc

SEQ ID NO: 972978 - DNA, 25 bp, Mus musculus
tttgatttaagctcgggcctctttc

SEQ ID NO: 972979 - DNA, 25 bp, Mus musculus
tttgatttcactaccagttgcaggt

SEQ ID NO: 972980 - DNA, 25 bp, Mus musculus
tttgatttcacttccagttgcaggt

SEQ ID NO: 972981 - DNA, 25 bp, Mus musculus
tttgatttcccgacagattagcaga

SEQ ID NO: 972982 - DNA, 25 bp, Mus musculus
tttgatttcccgtcagattagcaga

SEQ ID NO: 972983 - DNA, 25 bp, Mus musculus
tttgatttcctaaatgtatagatgc

SEQ ID NO: 972984 - DNA, 25 bp, Mus musculus
tttgatttcctatatgtatagatgc

SEQ ID NO: 972985 - DNA, 25 bp, Mus musculus
tttgatttctagctcagcttggtct

SEQ ID NO: 972986 - DNA, 25 bp, Mus musculus
tttgatttctaggtcagcttggtct

SEQ ID NO: 972987 - DNA, 25 bp, Mus musculus
tttgatttctatcgccaccagatgc

SEQ ID NO: 972988 - DNA, 25 bp, Mus musculus
tttgatttctatggccaccagatgc

SEQ ID NO: 972989 - DNA, 25 bp, Mus musculus
tttgatttctgcattcttggtgcca

SEQ ID NO: 972990 - DNA, 25 bp, Mus musculus
tttgatttctgctttcttggtgcca

SEQ ID NO: 972991 - DNA, 25 bp, Mus musculus
tttgatttctgtacgatttgctcct

SEQ ID NO: 972992 - DNA, 25 bp, Mus musculus
tttgatttctgttcgatttgctcct

SEQ ID NO: 972993 - DNA, 25 bp, Mus musculus
tttgatttgtgcagtgtggctggat

SEQ ID NO: 972994 - DNA, 25 bp, Mus musculus
tttgatttgtgctgtgtggctggat

SEQ ID NO: 972995 - DNA, 25 bp, Mus musculus
tttgattttccaagaatgcctctgt

SEQ ID NO: 972996 - DNA, 25 bp, Mus musculus
tttgattttccatgaatgcctctgt

SEQ ID NO: 972997 - DNA, 25 bp, Mus musculus
tttgattttgacaacgggaattgca

SEQ ID NO: 972998 - DNA, 25 bp, Mus musculus
tttgattttgactacgggaattgca

SEQ ID NO: 972999 - DNA, 25 bp, Mus musculus
tttgatttttcaatttgcacgaatt

SEQ ID NO: 973000 - DNA, 25 bp, Mus musculus
tttgatttttcattttgcacgaatt

SEQ ID NO: 973001 - DNA, 25 bp, Mus musculus
tttgatttttgactagggcttctct

SEQ ID NO: 973002 - DNA, 25 bp, Mus musculus
tttgatttttgagtagggcttctct

SEQ ID NO: 973003 - DNA, 25 bp, Mus musculus
tttgatttttgcatagagtaaacac

SEQ ID NO: 973004 - DNA, 25 bp, Mus musculus
tttgatttttgcttagagtaaacac

SEQ ID NO: 973005 - DNA, 25 bp, Mus musculus
tttgcaaacaaaaccccaggaccag

SEQ ID NO: 973006 - DNA, 25 bp, Mus musculus
tttgcaaacaaatccccaggaccag

SEQ ID NO: 973007 - DNA, 25 bp, Mus musculus
tttgcaaacactagacaggtgaccc

SEQ ID NO: 973008 - DNA, 25 bp, Mus musculus
tttgcaaacacttgacaggtgaccc

SEQ ID NO: 973009 - DNA, 25 bp, Mus musculus
tttgcaaacccaaatcacacagatc

SEQ ID NO: 973010 - DNA, 25 bp, Mus musculus
tttgcaaacccatatcacacagatc

SEQ ID NO: 973011 - DNA, 25 bp, Mus musculus
tttgcaaactgcatcttgttggaca

SEQ ID NO: 973012 - DNA, 25 bp, Mus musculus
tttgcaaactgcttcttgttggaca

SEQ ID NO: 973013 - DNA, 25 bp, Mus musculus
tttgcaaagctacagaaccttagta

SEQ ID NO: 973014 - DNA, 25 bp, Mus musculus
tttgcaaagctagagaaccttagta

SEQ ID NO: 973015 - DNA, 25 bp, Mus musculus
tttgcaaattcccacatattgtaaa

SEQ ID NO: 973016 - DNA, 25 bp, Mus musculus
tttgcaaattccgacatattgtaaa

SEQ ID NO: 973017 - DNA, 25 bp, Mus musculus
tttgcaacagccagccagcctagag

SEQ ID NO: 973018 - DNA, 25 bp, Mus musculus
tttgcaacagccctttaggtggaag

SEQ ID NO: 973019 - DNA, 25 bp, Mus musculus
tttgcaacagccgtttaggtggaag

SEQ ID NO: 973020 - DNA, 25 bp, Mus musculus
tttgcaacagcctgccagcctagag

SEQ ID NO: 973021 - DNA, 25 bp, Mus musculus
tttgcaaccaaacttcccaagcttg

SEQ ID NO: 973022 - DNA, 25 bp, Mus musculus
tttgcaaccaaagttcccaagcttg

SEQ ID NO: 973023 - DNA, 25 bp, Mus musculus
tttgcaaccacccttcatttgagtc

SEQ ID NO: 973024 - DNA, 25 bp, Mus musculus
tttgcaaccaccgttcatttgagtc

SEQ ID NO: 973025 - DNA, 25 bp, Mus musculus
tttgcaaccactcgatatcctggca

SEQ ID NO: 973026 - DNA, 25 bp, Mus musculus
tttgcaaccactggatatcctggca

SEQ ID NO: 973027 - DNA, 25 bp, Mus musculus
tttgcaacccaaattccttttatga

SEQ ID NO: 973028 - DNA, 25 bp, Mus musculus
tttgcaacccaatttccttttatga

SEQ ID NO: 973029 - DNA, 25 bp, Mus musculus
tttgcaacccctctgttaaaccaat

SEQ ID NO: 973030 - DNA, 25 bp, Mus musculus
tttgcaacccctgtgttaaaccaat

SEQ ID NO: 973031 - DNA, 25 bp, Mus musculus
tttgcaacctatcgatctggtcaga

SEQ ID NO: 973032 - DNA, 25 bp, Mus musculus
tttgcaacctatggatctggtcaga

SEQ ID NO: 973033 - DNA, 25 bp, Mus musculus
tttgcaacctttcttaaaagacgat

SEQ ID NO: 973034 - DNA, 25 bp, Mus musculus
tttgcaacctttgttaaaagacgat

SEQ ID NO: 973035 - DNA, 25 bp, Mus musculus
tttgcaactctacgcgcaaactgta

SEQ ID NO: 973036 - DNA, 25 bp, Mus musculus
tttgcaactctaggcgcaaactgta

SEQ ID NO: 973037 - DNA, 25 bp, Mus musculus
tttgcaactgatcggatcacacaca

SEQ ID NO: 973038 - DNA, 25 bp, Mus musculus
tttgcaactgatgggatcacacaca

SEQ ID NO: 973039 - DNA, 25 bp, Mus musculus
tttgcaacttacacctcaaattgtc

SEQ ID NO: 973040 - DNA, 25 bp, Mus musculus
tttgcaacttactcctcaaattgtc

SEQ ID NO: 973041 - DNA, 25 bp, Mus musculus
tttgcaagactgcaaggagcgcgca

SEQ ID NO: 973042 - DNA, 25 bp, Mus musculus
tttgcaagactggaaggagcgcgca

SEQ ID NO: 973043 - DNA, 25 bp, Mus musculus
tttgcaagagaaccgacactccggt

SEQ ID NO: 973044 - DNA, 25 bp, Mus musculus
tttgcaagagaagcgacactccggt

SEQ ID NO: 973045 - DNA, 25 bp, Mus musculus
tttgcaagcatgagtgtctgatttc

SEQ ID NO: 973046 - DNA, 25 bp, Mus musculus
tttgcaagcatgtgtgtctgatttc

SEQ ID NO: 973047 - DNA, 25 bp, Mus musculus
tttgcaagccttctcagaatcagtt

SEQ ID NO: 973048 - DNA, 25 bp, Mus musculus
tttgcaagccttgtcagaatcagtt

SEQ ID NO: 973049 - DNA, 25 bp, Mus musculus
tttgcaagggcgaccattggaccac

SEQ ID NO: 973050 - DNA, 25 bp, Mus musculus
tttgcaagggcgtccattggaccac

SEQ ID NO: 973051 - DNA, 25 bp, Mus musculus
tttgcaagtacaatggcctcagagt

SEQ ID NO: 973052 - DNA, 25 bp, Mus musculus
tttgcaagtacattggcctcagagt

SEQ ID NO: 973053 - DNA, 25 bp, Mus musculus
tttgcaagtggacttcgctctctct

SEQ ID NO: 973054 - DNA, 25 bp, Mus musculus
tttgcaagtggagttcgctctctct

SEQ ID NO: 973055 - DNA, 25 bp, Mus musculus
tttgcaagttgccatatgggtgcta

SEQ ID NO: 973056 - DNA, 25 bp, Mus musculus
tttgcaagttgcgatatgggtgcta

SEQ ID NO: 973057 - DNA, 25 bp, Mus musculus
tttgcaatacacacagtcctcaggg

SEQ ID NO: 973058 - DNA, 25 bp, Mus musculus
tttgcaatacactcagtcctcaggg

SEQ ID NO: 973059 - DNA, 25 bp, Mus musculus
tttgcaatcaggaccactggtggtt

SEQ ID NO: 973060 - DNA, 25 bp, Mus musculus
tttgcaatcaggtccactggtggtt

SEQ ID NO: 973061 - DNA, 25 bp, Mus musculus
tttgcaatcctaatacagggccagg

SEQ ID NO: 973062 - DNA, 25 bp, Mus musculus
tttgcaatcctattacagggccagg

SEQ ID NO: 973063 - DNA, 25 bp, Mus musculus
tttgcaatgggaaatacttaggctt

SEQ ID NO: 973064 - DNA, 25 bp, Mus musculus
tttgcaatgggatatacttaggctt

SEQ ID NO: 973065 - DNA, 25 bp, Mus musculus
tttgcaatggtgctccagcacccaa

SEQ ID NO: 973066 - DNA, 25 bp, Mus musculus
tttgcaatggtggtccagcacccaa

SEQ ID NO: 973067 - DNA, 25 bp, Mus musculus
tttgcaattattccatcctaccctg

SEQ ID NO: 973068 - DNA, 25 bp, Mus musculus
tttgcaattattgcatcctaccctg

SEQ ID NO: 973069 - DNA, 25 bp, Mus musculus
tttgcacaactcatgcctcatttta

SEQ ID NO: 973070 - DNA, 25 bp, Mus musculus
tttgcacaactcttgcctcatttta

SEQ ID NO: 973071 - DNA, 25 bp, Mus musculus
tttgcacaagcaatcggttctcagt

SEQ ID NO: 973072 - DNA, 25 bp, Mus musculus
tttgcacaagcattcggttctcagt

SEQ ID NO: 973073 - DNA, 25 bp, Mus musculus
tttgcacacaatattgaacccgttc

SEQ ID NO: 973074 - DNA, 25 bp, Mus musculus
tttgcacacaattttgaacccgttc

SEQ ID NO: 973075 - DNA, 25 bp, Mus musculus
tttgcacacagcacattcaagggct

SEQ ID NO: 973076 - DNA, 25 bp, Mus musculus
tttgcacacagccatctagcttaga

SEQ ID NO: 973077 - DNA, 25 bp, Mus musculus
tttgcacacagcgatctagcttaga

SEQ ID NO: 973078 - DNA, 25 bp, Mus musculus
tttgcacacagctcattcaagggct

SEQ ID NO: 973079 - DNA, 25 bp, Mus musculus
tttgcacaccggatttgagagcccc

SEQ ID NO: 973080 - DNA, 25 bp, Mus musculus
tttgcacaccggttttgagagcccc

SEQ ID NO: 973081 - DNA, 25 bp, Mus musculus
tttgcacacctgaaatcgcggaatt

SEQ ID NO: 973082 - DNA, 25 bp, Mus musculus
tttgcacacctgtaatcgcggaatt

SEQ ID NO: 973083 - DNA, 25 bp, Mus musculus
tttgcacactaaagaagggcattgg

SEQ ID NO: 973084 - DNA, 25 bp, Mus musculus
tttgcacactaatgaagggcattgg

SEQ ID NO: 973085 - DNA, 25 bp, Mus musculus
tttgcacagatgaattccacttccc

SEQ ID NO: 973086 - DNA, 25 bp, Mus musculus
tttgcacagatgtattccacttccc

SEQ ID NO: 973087 - DNA, 25 bp, Mus musculus
tttgcacaggccactgagcagtcat

SEQ ID NO: 973088 - DNA, 25 bp, Mus musculus
tttgcacaggcctctgagcagtcat

SEQ ID NO: 973089 - DNA, 25 bp, Mus musculus
tttgcacagggcattccccaactgt

SEQ ID NO: 973090 - DNA, 25 bp, Mus musculus
tttgcacagggctttccccaactgt

SEQ ID NO: 973091 - DNA, 25 bp, Mus musculus
tttgcacagtaaaaaccttccgcct

SEQ ID NO: 973092 - DNA, 25 bp, Mus musculus
tttgcacagtaataaccttccgcct

SEQ ID NO: 973093 - DNA, 25 bp, Mus musculus
tttgcacagttcaaacctatacaac

SEQ ID NO: 973094 - DNA, 25 bp, Mus musculus
tttgcacagttctaacctatacaac

SEQ ID NO: 973095 - DNA, 25 bp, Mus musculus
tttgcacatactccttgttgcttat

SEQ ID NO: 973096 - DNA, 25 bp, Mus musculus
tttgcacatactgcttgttgcttat

SEQ ID NO: 973097 - DNA, 25 bp, Mus musculus
tttgcacatcaaacgagtctccaat

SEQ ID NO: 973098 - DNA, 25 bp, Mus musculus
tttgcacatcaatcgagtctccaat

SEQ ID NO: 973099 - DNA, 25 bp, Mus musculus
tttgcacatgtgaccatgctgtgtt

SEQ ID NO: 973100 - DNA, 25 bp, Mus musculus
tttgcacatgtgtccatgctgtgtt

SEQ ID NO: 973101 - DNA, 25 bp, Mus musculus
tttgcacattgacttttggaattga

SEQ ID NO: 973102 - DNA, 25 bp, Mus musculus
tttgcacattgagttttggaattga

SEQ ID NO: 973103 - DNA, 25 bp, Mus musculus
tttgcacattgtccccagagtaatc

SEQ ID NO: 973104 - DNA, 25 bp, Mus musculus
tttgcacattgtgcccagagtaatc

SEQ ID NO: 973105 - DNA, 25 bp, Mus musculus
tttgcacattttatgagcagagggt

SEQ ID NO: 973106 - DNA, 25 bp, Mus musculus
tttgcacattttttgagcagagggt

SEQ ID NO: 973107 - DNA, 25 bp, Mus musculus
tttgcaccaccaattccaggagtgt

SEQ ID NO: 973108 - DNA, 25 bp, Mus musculus
tttgcaccaccatttccaggagtgt

SEQ ID NO: 973109 - DNA, 25 bp, Mus musculus
tttgcaccagctcatcacctgtgag

SEQ ID NO: 973110 - DNA, 25 bp, Mus musculus
tttgcaccagctcggcatcctttta

SEQ ID NO: 973111 - DNA, 25 bp, Mus musculus
tttgcaccagctgatcacctgtgag

SEQ ID NO: 973112 - DNA, 25 bp, Mus musculus
tttgcaccagctgggcatcctttta

SEQ ID NO: 973113 - DNA, 25 bp, Mus musculus
tttgcaccaggaaataaaacagttt

SEQ ID NO: 973114 - DNA, 25 bp, Mus musculus
tttgcaccaggatataaaacagttt

SEQ ID NO: 973115 - DNA, 25 bp, Mus musculus
tttgcacccagaacttcgacaatga

SEQ ID NO: 973116 - DNA, 25 bp, Mus musculus
tttgcacccagatcttcgacaatga

SEQ ID NO: 973117 - DNA, 25 bp, Mus musculus
tttgcacccaggattcaattttttg

SEQ ID NO: 973118 - DNA, 25 bp, Mus musculus
tttgcacccaggtttcaattttttg

SEQ ID NO: 973119 - DNA, 25 bp, Mus musculus
tttgcaccctctagtattcagctga

SEQ ID NO: 973120 - DNA, 25 bp, Mus musculus
tttgcaccctcttgtattcagctga

SEQ ID NO: 973121 - DNA, 25 bp, Mus musculus
tttgcaccgaaaagtggccgcagag

SEQ ID NO: 973122 - DNA, 25 bp, Mus musculus
tttgcaccgaaatgtggccgcagag

SEQ ID NO: 973123 - DNA, 25 bp, Mus musculus
tttgcaccgaggcatacgcctttgg

SEQ ID NO: 973124 - DNA, 25 bp, Mus musculus
tttgcaccgagggatacgcctttgg

SEQ ID NO: 973125 - DNA, 25 bp, Mus musculus
tttgcaccgtgtaccctaaacatgt

SEQ ID NO: 973126 - DNA, 25 bp, Mus musculus
tttgcaccgtgttccctaaacatgt

SEQ ID NO: 973127 - DNA, 25 bp, Mus musculus
tttgcacctagtctggcccgcagat

SEQ ID NO: 973128 - DNA, 25 bp, Mus musculus
tttgcacctagtgtggcccgcagat

SEQ ID NO: 973129 - DNA, 25 bp, Mus musculus
tttgcacctccaagacagcgacatg

SEQ ID NO: 973130 - DNA, 25 bp, Mus musculus
tttgcacctccatgacagcgacatg

SEQ ID NO: 973131 - DNA, 25 bp, Mus musculus
tttgcacctcccagtgatccatgaa

SEQ ID NO: 973132 - DNA, 25 bp, Mus musculus
tttgcacctccctgtgatccatgaa

SEQ ID NO: 973133 - DNA, 25 bp, Mus musculus
tttgcacctctgctgagttggctca

SEQ ID NO: 973134 - DNA, 25 bp, Mus musculus
tttgcacctctggtgagttggctca

SEQ ID NO: 973135 - DNA, 25 bp, Mus musculus
tttgcacctgacattgttctgcgaa

SEQ ID NO: 973136 - DNA, 25 bp, Mus musculus
tttgcacctgacatttcctagttgt

SEQ ID NO: 973137 - DNA, 25 bp, Mus musculus
tttgcacctgactttgttctgcgaa

SEQ ID NO: 973138 - DNA, 25 bp, Mus musculus
tttgcacctgacttttcctagttgt

SEQ ID NO: 973139 - DNA, 25 bp, Mus musculus
tttgcaccttaactcttggaactga

SEQ ID NO: 973140 - DNA, 25 bp, Mus musculus
tttgcaccttaagtcttggaactga

SEQ ID NO: 973141 - DNA, 25 bp, Mus musculus
tttgcaccttcaattatcccactta

SEQ ID NO: 973142 - DNA, 25 bp, Mus musculus
tttgcaccttcatttatcccactta

SEQ ID NO: 973143 - DNA, 25 bp, Mus musculus
tttgcaccttggcaagacttgcttt

SEQ ID NO: 973144 - DNA, 25 bp, Mus musculus
tttgcaccttgggaagacttgcttt

SEQ ID NO: 973145 - DNA, 25 bp, Mus musculus
tttgcaccttgtcatctttcaggaa

SEQ ID NO: 973146 - DNA, 25 bp, Mus musculus
tttgcaccttgtgatctttcaggaa

SEQ ID NO: 973147 - DNA, 25 bp, Mus musculus
tttgcaccttttcttgggaagtact

SEQ ID NO: 973148 - DNA, 25 bp, Mus musculus
tttgcaccttttgttgggaagtact

SEQ ID NO: 973149 - DNA, 25 bp, Mus musculus
tttgcacggagacattttctcacac

SEQ ID NO: 973150 - DNA, 25 bp, Mus musculus
tttgcacggagagattttctcacac

SEQ ID NO: 973151 - DNA, 25 bp, Mus musculus
tttgcacgtctcagctgctttcact

SEQ ID NO: 973152 - DNA, 25 bp, Mus musculus
tttgcacgtctctgctgctttcact

SEQ ID NO: 973153 - DNA, 25 bp, Mus musculus
tttgcactaaacagatttaccctta

SEQ ID NO: 973154 - DNA, 25 bp, Mus musculus
tttgcactaaactgatttaccctta

SEQ ID NO: 973155 - DNA, 25 bp, Mus musculus
tttgcactaggaaagcaggccaggt

SEQ ID NO: 973156 - DNA, 25 bp, Mus musculus
tttgcactaggatagcaggccaggt

SEQ ID NO: 973157 - DNA, 25 bp, Mus musculus
tttgcactatttaaagaaacccttg

SEQ ID NO: 973158 - DNA, 25 bp, Mus musculus
tttgcactattttaagaaacccttg

SEQ ID NO: 973159 - DNA, 25 bp, Mus musculus
tttgcactccacacaaatcacatac

SEQ ID NO: 973160 - DNA, 25 bp, Mus musculus
tttgcactccactcaaatcacatac

SEQ ID NO: 973161 - DNA, 25 bp, Mus musculus
tttgcactccagaccttggtgtggg

SEQ ID NO: 973162 - DNA, 25 bp, Mus musculus
tttgcactccagtccttggtgtggg

SEQ ID NO: 973163 - DNA, 25 bp, Mus musculus
tttgcactccttacagatgcagcca

SEQ ID NO: 973164 - DNA, 25 bp, Mus musculus
tttgcactccttccactcagcatga

SEQ ID NO: 973165 - DNA, 25 bp, Mus musculus
tttgcactccttgcactcagcatga

SEQ ID NO: 973166 - DNA, 25 bp, Mus musculus
tttgcactcctttcagatgcagcca

SEQ ID NO: 973167 - DNA, 25 bp, Mus musculus
tttgcactcgtaaacctgtggtagt

SEQ ID NO: 973168 - DNA, 25 bp, Mus musculus
tttgcactcgtatacctgtggtagt

SEQ ID NO: 973169 - DNA, 25 bp, Mus musculus
tttgcactcttaacgtctatgattt

SEQ ID NO: 973170 - DNA, 25 bp, Mus musculus
tttgcactcttatcgtctatgattt

SEQ ID NO: 973171 - DNA, 25 bp, Mus musculus
tttgcactgactctgcacagacaca

SEQ ID NO: 973172 - DNA, 25 bp, Mus musculus
tttgcactgactgtgcacagacaca

SEQ ID NO: 973173 - DNA, 25 bp, Mus musculus
tttgcactgagtcatgttctccgtc

SEQ ID NO: 973174 - DNA, 25 bp, Mus musculus
tttgcactgagtgatgttctccgtc

SEQ ID NO: 973175 - DNA, 25 bp, Mus musculus
tttgcactggctcagagcaccaggc

SEQ ID NO: 973176 - DNA, 25 bp, Mus musculus
tttgcactggctgagagcaccaggc

SEQ ID NO: 973177 - DNA, 25 bp, Mus musculus
tttgcactggtcagagctctgtgaa

SEQ ID NO: 973178 - DNA, 25 bp, Mus musculus
tttgcactggtctgagctctgtgaa

SEQ ID NO: 973179 - DNA, 25 bp, Mus musculus
tttgcactgtgaccctgatgatcta

SEQ ID NO: 973180 - DNA, 25 bp, Mus musculus
tttgcactgtgagcctgatgatcta

SEQ ID NO: 973181 - DNA, 25 bp, Mus musculus
tttgcactgtgcatcggagacttaa

SEQ ID NO: 973182 - DNA, 25 bp, Mus musculus
tttgcactgtgcttcggagacttaa

SEQ ID NO: 973183 - DNA, 25 bp, Mus musculus
tttgcactgtttccccagatggact

SEQ ID NO: 973184 - DNA, 25 bp, Mus musculus
tttgcactgtttgcccagatggact

SEQ ID NO: 973185 - DNA, 25 bp, Mus musculus
tttgcacttacacaagcacctttca

SEQ ID NO: 973186 - DNA, 25 bp, Mus musculus
tttgcacttacagaagcacctttca

SEQ ID NO: 973187 - DNA, 25 bp, Mus musculus
tttgcacttcgcagtcttcttcaag

SEQ ID NO: 973188 - DNA, 25 bp, Mus musculus
tttgcacttcgctgtcttcttcaag

SEQ ID NO: 973189 - DNA, 25 bp, Mus musculus
tttgcacttggaccagcctcacatt

SEQ ID NO: 973190 - DNA, 25 bp, Mus musculus
tttgcacttggagcagcctcacatt

SEQ ID NO: 973191 - DNA, 25 bp, Mus musculus
tttgcacttggcctctgggttcaca

SEQ ID NO: 973192 - DNA, 25 bp, Mus musculus
tttgcacttggcgtctgggttcaca

SEQ ID NO: 973193 - DNA, 25 bp, Mus musculus
tttgcagaacctcactccgaggaga

SEQ ID NO: 973194 - DNA, 25 bp, Mus musculus
tttgcagaacctgactccgaggaga

SEQ ID NO: 973195 - DNA, 25 bp, Mus musculus
tttgcagaactgattcaggtcagcc

SEQ ID NO: 973196 - DNA, 25 bp, Mus musculus
tttgcagaactgtttcaggtcagcc

SEQ ID NO: 973197 - DNA, 25 bp, Mus musculus
tttgcagaagaactcccttggtaag

SEQ ID NO: 973198 - DNA, 25 bp, Mus musculus
tttgcagaagaagtcccttggtaag

SEQ ID NO: 973199 - DNA, 25 bp, Mus musculus
tttgcagaagctactagtcacttgg

SEQ ID NO: 973200 - DNA, 25 bp, Mus musculus
tttgcagaagcttctagtcacttgg

SEQ ID NO: 973201 - DNA, 25 bp, Mus musculus
tttgcagacacaaggccacccatat

SEQ ID NO: 973202 - DNA, 25 bp, Mus musculus
tttgcagacacatggccacccatat

SEQ ID NO: 973203 - DNA, 25 bp, Mus musculus
tttgcagaccacagttcttggccaa

SEQ ID NO: 973204 - DNA, 25 bp, Mus musculus
tttgcagaccactgttcttggccaa

SEQ ID NO: 973205 - DNA, 25 bp, Mus musculus
tttgcagacttcctcgtctatgatg

SEQ ID NO: 973206 - DNA, 25 bp, Mus musculus
tttgcagacttcgtcgtctatgatg

SEQ ID NO: 973207 - DNA, 25 bp, Mus musculus
tttgcagagcatccgtgtttggttc

SEQ ID NO: 973208 - DNA, 25 bp, Mus musculus
tttgcagagcatgcgtgtttggttc

SEQ ID NO: 973209 - DNA, 25 bp, Mus musculus
tttgcagatgagctccggttgtcct

SEQ ID NO: 973210 - DNA, 25 bp, Mus musculus
tttgcagatgaggtccggttgtcct

SEQ ID NO: 973211 - DNA, 25 bp, Mus musculus
tttgcagatgataaggttgcccagt

SEQ ID NO: 973212 - DNA, 25 bp, Mus musculus
tttgcagatgattaggttgcccagt

SEQ ID NO: 973213 - DNA, 25 bp, Mus musculus
tttgcagatgccctgcccattggga

SEQ ID NO: 973214 - DNA, 25 bp, Mus musculus
tttgcagatgccgtgcccattggga

SEQ ID NO: 973215 - DNA, 25 bp, Mus musculus
tttgcagattggctaacacaggaac

SEQ ID NO: 973216 - DNA, 25 bp, Mus musculus
tttgcagattgggtaacacaggaac

SEQ ID NO: 973217 - DNA, 25 bp, Mus musculus
tttgcagcatacatgtctagcctcc

SEQ ID NO: 973218 - DNA, 25 bp, Mus musculus
tttgcagcatacttgtctagcctcc

SEQ ID NO: 973219 - DNA, 25 bp, Mus musculus
tttgcagccatacctctttggtgtt

SEQ ID NO: 973220 - DNA, 25 bp, Mus musculus
tttgcagccatagctctttggtgtt

SEQ ID NO: 973221 - DNA, 25 bp, Mus musculus
tttgcagcccaaatctagaaattag

SEQ ID NO: 973222 - DNA, 25 bp, Mus musculus
tttgcagcccaattctagaaattag

SEQ ID NO: 973223 - DNA, 25 bp, Mus musculus
tttgcagcccctaagcaaggatgct

SEQ ID NO: 973224 - DNA, 25 bp, Mus musculus
tttgcagccccttagcaaggatgct

SEQ ID NO: 973225 - DNA, 25 bp, Mus musculus
tttgcagccctcatgaactgtcgaa

SEQ ID NO: 973226 - DNA, 25 bp, Mus musculus
tttgcagccctccaaacaggtgtgc

SEQ ID NO: 973227 - DNA, 25 bp, Mus musculus
tttgcagccctcgaaacaggtgtgc

SEQ ID NO: 973228 - DNA, 25 bp, Mus musculus
tttgcagccctcttgaactgtcgaa

SEQ ID NO: 973229 - DNA, 25 bp, Mus musculus
tttgcagcccttcatgcacagcagg

SEQ ID NO: 973230 - DNA, 25 bp, Mus musculus
tttgcagcccttgatgcacagcagg

SEQ ID NO: 973231 - DNA, 25 bp, Mus musculus
tttgcagcctccaaagcaactggaa

SEQ ID NO: 973232 - DNA, 25 bp, Mus musculus
tttgcagcctcctaagcaactggaa

SEQ ID NO: 973233 - DNA, 25 bp, Mus musculus
tttgcagcctgtatctgtcatgtag

SEQ ID NO: 973234 - DNA, 25 bp, Mus musculus
tttgcagcctgtttctgtcatgtag

SEQ ID NO: 973235 - DNA, 25 bp, Mus musculus
tttgcagctcctacatcaaagagat

SEQ ID NO: 973236 - DNA, 25 bp, Mus musculus
tttgcagctccttcatcaaagagat

SEQ ID NO: 973237 - DNA, 25 bp, Mus musculus
tttgcagctgatcaaggtgatacgt

SEQ ID NO: 973238 - DNA, 25 bp, Mus musculus
tttgcagctgatgaaggtgatacgt

SEQ ID NO: 973239 - DNA, 25 bp, Mus musculus
tttgcagctgggattcctcagtgac

SEQ ID NO: 973240 - DNA, 25 bp, Mus musculus
tttgcagctgggtttcctcagtgac

SEQ ID NO: 973241 - DNA, 25 bp, Mus musculus
tttgcagcttgccgcggaatcacag

SEQ ID NO: 973242 - DNA, 25 bp, Mus musculus
tttgcagcttgcggcggaatcacag

SEQ ID NO: 973243 - DNA, 25 bp, Mus musculus
tttgcaggaacacacctgcgtcctt

SEQ ID NO: 973244 - DNA, 25 bp, Mus musculus
tttgcaggaacagacctgcgtcctt

SEQ ID NO: 973245 - DNA, 25 bp, Mus musculus
tttgcaggactcagaggtcatctcg

SEQ ID NO: 973246 - DNA, 25 bp, Mus musculus
tttgcaggactctgaggtcatctcg

SEQ ID NO: 973247 - DNA, 25 bp, Mus musculus
tttgcaggagagctgatgccattcc

SEQ ID NO: 973248 - DNA, 25 bp, Mus musculus
tttgcaggagaggtgatgccattcc

SEQ ID NO: 973249 - DNA, 25 bp, Mus musculus
tttgcaggcattatagcagtgtata

SEQ ID NO: 973250 - DNA, 25 bp, Mus musculus
tttgcaggcattttagcagtgtata

SEQ ID NO: 973251 - DNA, 25 bp, Mus musculus
tttgcaggccgtatcccacaaacag

SEQ ID NO: 973252 - DNA, 25 bp, Mus musculus
tttgcaggccgtttcccacaaacag

SEQ ID NO: 973253 - DNA, 25 bp, Mus musculus
tttgcaggcgccattaccagcaggg

SEQ ID NO: 973254 - DNA, 25 bp, Mus musculus
tttgcaggcgcctttaccagcaggg

SEQ ID NO: 973255 - DNA, 25 bp, Mus musculus
tttgcaggctacacttggaaaggct

SEQ ID NO: 973256 - DNA, 25 bp, Mus musculus
tttgcaggctactcttggaaaggct

SEQ ID NO: 973257 - DNA, 25 bp, Mus musculus
tttgcaggctcacccaatgcttgag

SEQ ID NO: 973258 - DNA, 25 bp, Mus musculus
tttgcaggctcagccaatgcttgag

SEQ ID NO: 973259 - DNA, 25 bp, Mus musculus
tttgcagggaggacattaactagtg

SEQ ID NO: 973260 - DNA, 25 bp, Mus musculus
tttgcagggaggtcattaactagtg

SEQ ID NO: 973261 - DNA, 25 bp, Mus musculus
tttgcaggtacaccctcctaggaag

SEQ ID NO: 973262 - DNA, 25 bp, Mus musculus
tttgcaggtacagcctcctaggaag

SEQ ID NO: 973263 - DNA, 25 bp, Mus musculus
tttgcaggtcccagatacagatact

SEQ ID NO: 973264 - DNA, 25 bp, Mus musculus
tttgcaggtccctgatacagatact

SEQ ID NO: 973265 - DNA, 25 bp, Mus musculus
tttgcaggtcggctcattgagttac

SEQ ID NO: 973266 - DNA, 25 bp, Mus musculus
tttgcaggtcgggtcattgagttac

SEQ ID NO: 973267 - DNA, 25 bp, Mus musculus
tttgcagtcaaactcaggttgatct

SEQ ID NO: 973268 - DNA, 25 bp, Mus musculus
tttgcagtcaaagtcaggttgatct

SEQ ID NO: 973269 - DNA, 25 bp, Mus musculus
tttgcagtctggcactgagagcctg

SEQ ID NO: 973270 - DNA, 25 bp, Mus musculus
tttgcagtctgggactgagagcctg

SEQ ID NO: 973271 - DNA, 25 bp, Mus musculus
tttgcagtctgtaacctaagggttg

SEQ ID NO: 973272 - DNA, 25 bp, Mus musculus
tttgcagtctgtattagagggctat

SEQ ID NO: 973273 - DNA, 25 bp, Mus musculus
tttgcagtctgttacctaagggttg

SEQ ID NO: 973274 - DNA, 25 bp, Mus musculus
tttgcagtctgttttagagggctat

SEQ ID NO: 973275 - DNA, 25 bp, Mus musculus
tttgcagtctttctgttcctgtact

SEQ ID NO: 973276 - DNA, 25 bp, Mus musculus
tttgcagtctttgtgttcctgtact

SEQ ID NO: 973277 - DNA, 25 bp, Mus musculus
tttgcagtgagtctagaccatccca

SEQ ID NO: 973278 - DNA, 25 bp, Mus musculus
tttgcagtgagtgtagaccatccca

SEQ ID NO: 973279 - DNA, 25 bp, Mus musculus
tttgcagtggccctagcatcttaaa

SEQ ID NO: 973280 - DNA, 25 bp, Mus musculus
tttgcagtggccgtagcatcttaaa

SEQ ID NO: 973281 - DNA, 25 bp, Mus musculus
tttgcagtgttaacatgccctgcct

SEQ ID NO: 973282 - DNA, 25 bp, Mus musculus
tttgcagtgttatcatgccctgcct

SEQ ID NO: 973283 - DNA, 25 bp, Mus musculus
tttgcagtttatagaaagtagttct

SEQ ID NO: 973284 - DNA, 25 bp, Mus musculus
tttgcagtttattgaaagtagttct

SEQ ID NO: 973285 - DNA, 25 bp, Mus musculus
tttgcataaattctaccactgttcg

SEQ ID NO: 973286 - DNA, 25 bp, Mus musculus
tttgcataaattgtaccactgttcg

SEQ ID NO: 973287 - DNA, 25 bp, Mus musculus
tttgcataagcccaggaacccatct

SEQ ID NO: 973288 - DNA, 25 bp, Mus musculus
tttgcataagccgaggaacccatct

SEQ ID NO: 973289 - DNA, 25 bp, Mus musculus
tttgcataaggcacaacagtccctg

SEQ ID NO: 973290 - DNA, 25 bp, Mus musculus
tttgcataaggctcaacagtccctg

SEQ ID NO: 973291 - DNA, 25 bp, Mus musculus
tttgcatagtgcattctgattggtt

SEQ ID NO: 973292 - DNA, 25 bp, Mus musculus
tttgcatagtgctttctgattggtt

SEQ ID NO: 973293 - DNA, 25 bp, Mus musculus
tttgcatagttcctgtcctgggaga

SEQ ID NO: 973294 - DNA, 25 bp, Mus musculus
tttgcatagttcgtgtcctgggaga

SEQ ID NO: 973295 - DNA, 25 bp, Mus musculus
tttgcatatatcctgcatgacctaa

SEQ ID NO: 973296 - DNA, 25 bp, Mus musculus
tttgcatatatcgtgcatgacctaa

SEQ ID NO: 973297 - DNA, 25 bp, Mus musculus
tttgcatatctgagatttctgactt

SEQ ID NO: 973298 - DNA, 25 bp, Mus musculus
tttgcatatctgtgatttctgactt

SEQ ID NO: 973299 - DNA, 25 bp, Mus musculus
tttgcatatgtaatccatcctgtac

SEQ ID NO: 973300 - DNA, 25 bp, Mus musculus
tttgcatatgtattccatcctgtac

SEQ ID NO: 973301 - DNA, 25 bp, Mus musculus
tttgcatatgtcatgagtctcctca

SEQ ID NO: 973302 - DNA, 25 bp, Mus musculus
tttgcatatgtcttgagtctcctca

SEQ ID NO: 973303 - DNA, 25 bp, Mus musculus
tttgcatattataaccacacgggta

SEQ ID NO: 973304 - DNA, 25 bp, Mus musculus
tttgcatattattaccacacgggta

SEQ ID NO: 973305 - DNA, 25 bp, Mus musculus
tttgcatattgccataactttgata

SEQ ID NO: 973306 - DNA, 25 bp, Mus musculus
tttgcatattgcgataactttgata

SEQ ID NO: 973307 - DNA, 25 bp, Mus musculus
tttgcatcaaacacttacacggagg

SEQ ID NO: 973308 - DNA, 25 bp, Mus musculus
tttgcatcaaactcttacacggagg

SEQ ID NO: 973309 - DNA, 25 bp, Mus musculus
tttgcatcaatcaggtctgtctcct

SEQ ID NO: 973310 - DNA, 25 bp, Mus musculus
tttgcatcaatctggtctgtctcct

SEQ ID NO: 973311 - DNA, 25 bp, Mus musculus
tttgcatcacagctaagaaacctaa

SEQ ID NO: 973312 - DNA, 25 bp, Mus musculus
tttgcatcacaggtaagaaacctaa

SEQ ID NO: 973313 - DNA, 25 bp, Mus musculus
tttgcatcatatactgtccgtactg

SEQ ID NO: 973314 - DNA, 25 bp, Mus musculus
tttgcatcatattctgtccgtactg

SEQ ID NO: 973315 - DNA, 25 bp, Mus musculus
tttgcatcatgcagtaaactaggaa

SEQ ID NO: 973316 - DNA, 25 bp, Mus musculus
tttgcatcatgctgtaaactaggaa

SEQ ID NO: 973317 - DNA, 25 bp, Mus musculus
tttgcatcccctcgtgaggcagagg

SEQ ID NO: 973318 - DNA, 25 bp, Mus musculus
tttgcatcccctggtgaggcagagg

SEQ ID NO: 973319 - DNA, 25 bp, Mus musculus
tttgcatccctcagcccgtatgtac

SEQ ID NO: 973320 - DNA, 25 bp, Mus musculus
tttgcatccctctgcccgtatgtac

SEQ ID NO: 973321 - DNA, 25 bp, Mus musculus
tttgcatcctaacccgtgttttcaa

SEQ ID NO: 973322 - DNA, 25 bp, Mus musculus
tttgcatcctaagccgtgttttcaa

SEQ ID NO: 973323 - DNA, 25 bp, Mus musculus
tttgcatcctgtatatcaaaatgga

SEQ ID NO: 973324 - DNA, 25 bp, Mus musculus
tttgcatcctgtttatcaaaatgga

SEQ ID NO: 973325 - DNA, 25 bp, Mus musculus
tttgcatcctttcacacccaattct

SEQ ID NO: 973326 - DNA, 25 bp, Mus musculus
tttgcatcctttgacacccaattct

SEQ ID NO: 973327 - DNA, 25 bp, Mus musculus
tttgcatcgagtacgtaaagaccaa

SEQ ID NO: 973328 - DNA, 25 bp, Mus musculus
tttgcatcgagttcgtaaagaccaa

SEQ ID NO: 973329 - DNA, 25 bp, Mus musculus
tttgcatctaccagacacatatttg

SEQ ID NO: 973330 - DNA, 25 bp, Mus musculus
tttgcatctacctgacacatatttg

SEQ ID NO: 973331 - DNA, 25 bp, Mus musculus
tttgcatctgacacgcagtctgaag

SEQ ID NO: 973332 - DNA, 25 bp, Mus musculus
tttgcatctgactcgcagtctgaag

SEQ ID NO: 973333 - DNA, 25 bp, Mus musculus
tttgcatctgcccttttcaggaatg

SEQ ID NO: 973334 - DNA, 25 bp, Mus musculus
tttgcatctgccgttttcaggaatg

SEQ ID NO: 973335 - DNA, 25 bp, Mus musculus
tttgcatgagtcaatatcacagtgc

SEQ ID NO: 973336 - DNA, 25 bp, Mus musculus
tttgcatgagtctatatcacagtgc

SEQ ID NO: 973337 - DNA, 25 bp, Mus musculus
tttgcatgcatgaagtctaggtgtc

SEQ ID NO: 973338 - DNA, 25 bp, Mus musculus
tttgcatgcatgtagtctaggtgtc

SEQ ID NO: 973339 - DNA, 25 bp, Mus musculus
tttgcatgccaaaaccttagctttt

SEQ ID NO: 973340 - DNA, 25 bp, Mus musculus
tttgcatgccaataccttagctttt

SEQ ID NO: 973341 - DNA, 25 bp, Mus musculus
tttgcatgctgcatctgggtagaga

SEQ ID NO: 973342 - DNA, 25 bp, Mus musculus
tttgcatgctgcttctgggtagaga

SEQ ID NO: 973343 - DNA, 25 bp, Mus musculus
tttgcatggaaaagagcctcagcct

SEQ ID NO: 973344 - DNA, 25 bp, Mus musculus
tttgcatggaaatgagcctcagcct

SEQ ID NO: 973345 - DNA, 25 bp, Mus musculus
tttgcatggacacagattagctgaa

SEQ ID NO: 973346 - DNA, 25 bp, Mus musculus
tttgcatggacagagattagctgaa

SEQ ID NO: 973347 - DNA, 25 bp, Mus musculus
tttgcatggcccctctgaagacaat

SEQ ID NO: 973348 - DNA, 25 bp, Mus musculus
tttgcatggcccgtctgaagacaat

SEQ ID NO: 973349 - DNA, 25 bp, Mus musculus
tttgcatggcttagcactgcagtag

SEQ ID NO: 973350 - DNA, 25 bp, Mus musculus
tttgcatggcttattctctttccat

SEQ ID NO: 973351 - DNA, 25 bp, Mus musculus
tttgcatggcttcgtgtatctgata

SEQ ID NO: 973352 - DNA, 25 bp, Mus musculus
tttgcatggcttcttcctccaggtt

SEQ ID NO: 973353 - DNA, 25 bp, Mus musculus
tttgcatggcttggtgtatctgata

SEQ ID NO: 973354 - DNA, 25 bp, Mus musculus
tttgcatggcttgttcctccaggtt

SEQ ID NO: 973355 - DNA, 25 bp, Mus musculus
tttgcatggctttgcactgcagtag

SEQ ID NO: 973356 - DNA, 25 bp, Mus musculus
tttgcatggctttttctctttccat

SEQ ID NO: 973357 - DNA, 25 bp, Mus musculus
tttgcatggtgtctcgagaaagagt

SEQ ID NO: 973358 - DNA, 25 bp, Mus musculus
tttgcatggtgtgtcgagaaagagt

SEQ ID NO: 973359 - DNA, 25 bp, Mus musculus
tttgcatggttcctttctgactttg

SEQ ID NO: 973360 - DNA, 25 bp, Mus musculus
tttgcatggttcgtttctgactttg

SEQ ID NO: 973361 - DNA, 25 bp, Mus musculus
tttgcatgtactctaatggccttgt

SEQ ID NO: 973362 - DNA, 25 bp, Mus musculus
tttgcatgtactgtaatggccttgt

SEQ ID NO: 973363 - DNA, 25 bp, Mus musculus
tttgcatgtctgataaccccagagt

SEQ ID NO: 973364 - DNA, 25 bp, Mus musculus
tttgcatgtctgttaaccccagagt

SEQ ID NO: 973365 - DNA, 25 bp, Mus musculus
tttgcatgtcttcccaagagttctg

SEQ ID NO: 973366 - DNA, 25 bp, Mus musculus
tttgcatgtcttgccaagagttctg

SEQ ID NO: 973367 - DNA, 25 bp, Mus musculus
tttgcatgttccactaaccttgagc

SEQ ID NO: 973368 - DNA, 25 bp, Mus musculus
tttgcatgttcctctaaccttgagc

SEQ ID NO: 973369 - DNA, 25 bp, Mus musculus
tttgcatgttctacaccctattgcc

SEQ ID NO: 973370 - DNA, 25 bp, Mus musculus
tttgcatgttcttcaccctattgcc

SEQ ID NO: 973371 - DNA, 25 bp, Mus musculus
tttgcattaaatcctggggtccatt

SEQ ID NO: 973372 - DNA, 25 bp, Mus musculus
tttgcattaaatgctggggtccatt

SEQ ID NO: 973373 - DNA, 25 bp, Mus musculus
tttgcattagagcattattgacccc

SEQ ID NO: 973374 - DNA, 25 bp, Mus musculus
tttgcattagaggattattgacccc

SEQ ID NO: 973375 - DNA, 25 bp, Mus musculus
tttgcattatgtacagactgtaacc

SEQ ID NO: 973376 - DNA, 25 bp, Mus musculus
tttgcattatgttcagactgtaacc

SEQ ID NO: 973377 - DNA, 25 bp, Mus musculus
tttgcattcattagccttagggcct

SEQ ID NO: 973378 - DNA, 25 bp, Mus musculus
tttgcattcatttgccttagggcct

SEQ ID NO: 973379 - DNA, 25 bp, Mus musculus
tttgcattccaaagctttccagcat

SEQ ID NO: 973380 - DNA, 25 bp, Mus musculus
tttgcattccaatgctttccagcat

SEQ ID NO: 973381 - DNA, 25 bp, Mus musculus
tttgcattcggtccaagacctcagc

SEQ ID NO: 973382 - DNA, 25 bp, Mus musculus
tttgcattcggtgcaagacctcagc

SEQ ID NO: 973383 - DNA, 25 bp, Mus musculus
tttgcattctaccagctgtttctgg

SEQ ID NO: 973384 - DNA, 25 bp, Mus musculus
tttgcattctacgagctgtttctgg

SEQ ID NO: 973385 - DNA, 25 bp, Mus musculus
tttgcattctttagccgctgcaata

SEQ ID NO: 973386 - DNA, 25 bp, Mus musculus
tttgcattcttttgccgctgcaata

SEQ ID NO: 973387 - DNA, 25 bp, Mus musculus
tttgcattgcaaaaccttttaggat

SEQ ID NO: 973388 - DNA, 25 bp, Mus musculus
tttgcattgcaataccttttaggat

SEQ ID NO: 973389 - DNA, 25 bp, Mus musculus
tttgcattgcaccagaggatccctg

SEQ ID NO: 973390 - DNA, 25 bp, Mus musculus
tttgcattgcacgagaggatccctg

SEQ ID NO: 973391 - DNA, 25 bp, Mus musculus
tttgcattgtttctgtgtcttgtat

SEQ ID NO: 973392 - DNA, 25 bp, Mus musculus
tttgcattgtttgtgtgtcttgtat

SEQ ID NO: 973393 - DNA, 25 bp, Mus musculus
tttgcatttatacctcttacctctt

SEQ ID NO: 973394 - DNA, 25 bp, Mus musculus
tttgcatttatagctcttacctctt

SEQ ID NO: 973395 - DNA, 25 bp, Mus musculus
tttgccaaagatagtaaatatttat

SEQ ID NO: 973396 - DNA, 25 bp, Mus musculus
tttgccaaagattgtaaatatttat

SEQ ID NO: 973397 - DNA, 25 bp, Mus musculus
tttgccaaagccagagtctccctca

SEQ ID NO: 973398 - DNA, 25 bp, Mus musculus
tttgccaaagcctgagtctccctca

SEQ ID NO: 973399 - DNA, 25 bp, Mus musculus
tttgccaaagctcaggaagaactcc

SEQ ID NO: 973400 - DNA, 25 bp, Mus musculus
tttgccaaagctgaggaagaactcc

SEQ ID NO: 973401 - DNA, 25 bp, Mus musculus
tttgccaaatccattgtgcgtgcac

SEQ ID NO: 973402 - DNA, 25 bp, Mus musculus
tttgccaaatcctttgtgcgtgcac

SEQ ID NO: 973403 - DNA, 25 bp, Mus musculus
tttgccaaatggcaatacttgcaga

SEQ ID NO: 973404 - DNA, 25 bp, Mus musculus
tttgccaaatgggaatacttgcaga

SEQ ID NO: 973405 - DNA, 25 bp, Mus musculus
tttgccaaattgcataccccattcc

SEQ ID NO: 973406 - DNA, 25 bp, Mus musculus
tttgccaaattggataccccattcc

SEQ ID NO: 973407 - DNA, 25 bp, Mus musculus
tttgccaaccttagtcttcatattc

SEQ ID NO: 973408 - DNA, 25 bp, Mus musculus
tttgccaaccttatattatgacact

SEQ ID NO: 973409 - DNA, 25 bp, Mus musculus
tttgccaacctttgtcttcatattc

SEQ ID NO: 973410 - DNA, 25 bp, Mus musculus
tttgccaaccttttattatgacact

SEQ ID NO: 973411 - DNA, 25 bp, Mus musculus
tttgccaacttcatctgagctgagt

SEQ ID NO: 973412 - DNA, 25 bp, Mus musculus
tttgccaacttcttctgagctgagt

SEQ ID NO: 973413 - DNA, 25 bp, Mus musculus
tttgccaagactcggtaagactcct

SEQ ID NO: 973414 - DNA, 25 bp, Mus musculus
tttgccaagactgggtaagactcct

SEQ ID NO: 973415 - DNA, 25 bp, Mus musculus
tttgccaaggcactgacacatttcg

SEQ ID NO: 973416 - DNA, 25 bp, Mus musculus
tttgccaaggcagtgacacatttcg

SEQ ID NO: 973417 - DNA, 25 bp, Mus musculus
tttgccaagggcaaagggacctttg

SEQ ID NO: 973418 - DNA, 25 bp, Mus musculus
tttgccaagggctaagggacctttg

SEQ ID NO: 973419 - DNA, 25 bp, Mus musculus
tttgccaagtggaaaagccttctct

SEQ ID NO: 973420 - DNA, 25 bp, Mus musculus
tttgccaagtggtaaagccttctct

SEQ ID NO: 973421 - DNA, 25 bp, Mus musculus
tttgccaatgcaaaggactgggact

SEQ ID NO: 973422 - DNA, 25 bp, Mus musculus
tttgccaatgcataggactgggact

SEQ ID NO: 973423 - DNA, 25 bp, Mus musculus
tttgccaatgggatttccccacaag

SEQ ID NO: 973424 - DNA, 25 bp, Mus musculus
tttgccaatgggttttccccacaag

SEQ ID NO: 973425 - DNA, 25 bp, Mus musculus
tttgccaattacaaaccctgcactt

SEQ ID NO: 973426 - DNA, 25 bp, Mus musculus
tttgccaattactaaccctgcactt

SEQ ID NO: 973427 - DNA, 25 bp, Mus musculus
tttgccaattctagctctcgagata

SEQ ID NO: 973428 - DNA, 25 bp, Mus musculus
tttgccaattcttgctctcgagata

SEQ ID NO: 973429 - DNA, 25 bp, Mus musculus
tttgccacaaggctgtgcttccaat

SEQ ID NO: 973430 - DNA, 25 bp, Mus musculus
tttgccacaagggtgtgcttccaat

SEQ ID NO: 973431 - DNA, 25 bp, Mus musculus
tttgccacacatactcagagataca

SEQ ID NO: 973432 - DNA, 25 bp, Mus musculus
tttgccacacattctcagagataca

SEQ ID NO: 973433 - DNA, 25 bp, Mus musculus
tttgccacagcaatccagaacagga

SEQ ID NO: 973434 - DNA, 25 bp, Mus musculus
tttgccacagcattccagaacagga

SEQ ID NO: 973435 - DNA, 25 bp, Mus musculus
tttgccacaggcagtgtgtccatcc

SEQ ID NO: 973436 - DNA, 25 bp, Mus musculus
tttgccacaggctgtgtgtccatcc

SEQ ID NO: 973437 - DNA, 25 bp, Mus musculus
tttgccacatagcttttggttcctt

SEQ ID NO: 973438 - DNA, 25 bp, Mus musculus
tttgccacataggttttggttcctt

SEQ ID NO: 973439 - DNA, 25 bp, Mus musculus
tttgccacatggactgtaagtcaca

SEQ ID NO: 973440 - DNA, 25 bp, Mus musculus
tttgccacatggtctgtaagtcaca

SEQ ID NO: 973441 - DNA, 25 bp, Mus musculus
tttgccacattacatctgatgagta

SEQ ID NO: 973442 - DNA, 25 bp, Mus musculus
tttgccacattagatctgatgagta

SEQ ID NO: 973443 - DNA, 25 bp, Mus musculus
tttgccacatttactcaactctagc

SEQ ID NO: 973444 - DNA, 25 bp, Mus musculus
tttgccacattttctcaactctagc

SEQ ID NO: 973445 - DNA, 25 bp, Mus musculus
tttgccaccacaagacatcattctt

SEQ ID NO: 973446 - DNA, 25 bp, Mus musculus
tttgccaccacatgacatcattctt

SEQ ID NO: 973447 - DNA, 25 bp, Mus musculus
tttgccaccagcagcttagaaactg

SEQ ID NO: 973448 - DNA, 25 bp, Mus musculus
tttgccaccagctgcttagaaactg

SEQ ID NO: 973449 - DNA, 25 bp, Mus musculus
tttgccacccaacgttggctttctc

SEQ ID NO: 973450 - DNA, 25 bp, Mus musculus
tttgccacccaaggttggctttctc

SEQ ID NO: 973451 - DNA, 25 bp, Mus musculus
tttgccacccatatattcaaaacat

SEQ ID NO: 973452 - DNA, 25 bp, Mus musculus
tttgccacccatttattcaaaacat

SEQ ID NO: 973453 - DNA, 25 bp, Mus musculus
tttgccaccgttcgaacagccagct

SEQ ID NO: 973454 - DNA, 25 bp, Mus musculus
tttgccaccgttggaacagccagct

SEQ ID NO: 973455 - DNA, 25 bp, Mus musculus
tttgccaccttcctttgtactcttt

SEQ ID NO: 973456 - DNA, 25 bp, Mus musculus
tttgccaccttcgtttgtactcttt

SEQ ID NO: 973457 - DNA, 25 bp, Mus musculus
tttgccacgcacataaaaacctcat

SEQ ID NO: 973458 - DNA, 25 bp, Mus musculus
tttgccacgcacttaaaaacctcat

SEQ ID NO: 973459 - DNA, 25 bp, Mus musculus
tttgccactattcccgggctagaaa

SEQ ID NO: 973460 - DNA, 25 bp, Mus musculus
tttgccactattgccgggctagaaa

SEQ ID NO: 973461 - DNA, 25 bp, Mus musculus
tttgccactcagacctacatcgggt

SEQ ID NO: 973462 - DNA, 25 bp, Mus musculus
tttgccactcagtcctacatcgggt

SEQ ID NO: 973463 - DNA, 25 bp, Mus musculus
tttgccactctccactgagtgactg

SEQ ID NO: 973464 - DNA, 25 bp, Mus musculus
tttgccactctcgactgagtgactg

SEQ ID NO: 973465 - DNA, 25 bp, Mus musculus
tttgccactgctcattcaatcagac

SEQ ID NO: 973466 - DNA, 25 bp, Mus musculus
tttgccactgctgattcaatcagac

SEQ ID NO: 973467 - DNA, 25 bp, Mus musculus
tttgccactgtacttccgaattcat

SEQ ID NO: 973468 - DNA, 25 bp, Mus musculus
tttgccactgtagttccgaattcat

SEQ ID NO: 973469 - DNA, 25 bp, Mus musculus
tttgccagacgtcgttcctgatggg

SEQ ID NO: 973470 - DNA, 25 bp, Mus musculus
tttgccagacgtggttcctgatggg

SEQ ID NO: 973471 - DNA, 25 bp, Mus musculus
tttgccagactcacagcaacaacac

SEQ ID NO: 973472 - DNA, 25 bp, Mus musculus
tttgccagactctcagcaacaacac

SEQ ID NO: 973473 - DNA, 25 bp, Mus musculus
tttgccagagagctgcagtgcccgt

SEQ ID NO: 973474 - DNA, 25 bp, Mus musculus
tttgccagagaggtgcagtgcccgt

SEQ ID NO: 973475 - DNA, 25 bp, Mus musculus
tttgccagcaaactagcagctaccc

SEQ ID NO: 973476 - DNA, 25 bp, Mus musculus
tttgccagcaaagtagcagctaccc

SEQ ID NO: 973477 - DNA, 25 bp, Mus musculus
tttgccagcagcagctagttactat

SEQ ID NO: 973478 - DNA, 25 bp, Mus musculus
tttgccagcagctgctagttactat

SEQ ID NO: 973479 - DNA, 25 bp, Mus musculus
tttgccagcaggaactcccagctga

SEQ ID NO: 973480 - DNA, 25 bp, Mus musculus
tttgccagcaggtactcccagctga

SEQ ID NO: 973481 - DNA, 25 bp, Mus musculus
tttgccagccaactgatgcgctatg

SEQ ID NO: 973482 - DNA, 25 bp, Mus musculus
tttgccagccaagtgatgcgctatg

SEQ ID NO: 973483 - DNA, 25 bp, Mus musculus
tttgccagccacataggcgacagag

SEQ ID NO: 973484 - DNA, 25 bp, Mus musculus
tttgccagccacttaggcgacagag

SEQ ID NO: 973485 - DNA, 25 bp, Mus musculus
tttgccagccagagattttctttta

SEQ ID NO: 973486 - DNA, 25 bp, Mus musculus
tttgccagccagtgattttctttta

SEQ ID NO: 973487 - DNA, 25 bp, Mus musculus
tttgccagcgaaatacaggttttgt

SEQ ID NO: 973488 - DNA, 25 bp, Mus musculus
tttgccagcgaattacaggttttgt

SEQ ID NO: 973489 - DNA, 25 bp, Mus musculus
tttgccagctcaccagaactagtga

SEQ ID NO: 973490 - DNA, 25 bp, Mus musculus
tttgccagctcagcagaactagtga

SEQ ID NO: 973491 - DNA, 25 bp, Mus musculus
tttgccaggccaccactggtgaggc

SEQ ID NO: 973492 - DNA, 25 bp, Mus musculus
tttgccaggccagcactggtgaggc

SEQ ID NO: 973493 - DNA, 25 bp, Mus musculus
tttgccaggcccaatacagtgaggt

SEQ ID NO: 973494 - DNA, 25 bp, Mus musculus
tttgccaggccctatacagtgaggt

SEQ ID NO: 973495 - DNA, 25 bp, Mus musculus
tttgccagggcacacccgattctca

SEQ ID NO: 973496 - DNA, 25 bp, Mus musculus
tttgccagggcaccaaggacttgta

SEQ ID NO: 973497 - DNA, 25 bp, Mus musculus
tttgccagggcagacccgattctca

SEQ ID NO: 973498 - DNA, 25 bp, Mus musculus
tttgccagggcagcaaggacttgta

SEQ ID NO: 973499 - DNA, 25 bp, Mus musculus
tttgccagggttctccgaggataca

SEQ ID NO: 973500 - DNA, 25 bp, Mus musculus
tttgccagggttgtccgaggataca

SEQ ID NO: 973501 - DNA, 25 bp, Mus musculus
tttgccaggtcaacaaggactgctt

SEQ ID NO: 973502 - DNA, 25 bp, Mus musculus
tttgccaggtcatcaaggactgctt

SEQ ID NO: 973503 - DNA, 25 bp, Mus musculus
tttgccagtcagaatagtgcacacc

SEQ ID NO: 973504 - DNA, 25 bp, Mus musculus
tttgccagtcagtatagtgcacacc

SEQ ID NO: 973505 - DNA, 25 bp, Mus musculus
tttgccagtgggattttctgcagtt

SEQ ID NO: 973506 - DNA, 25 bp, Mus musculus
tttgccagtgggtttttctgcagtt

SEQ ID NO: 973507 - DNA, 25 bp, Mus musculus
tttgccagtgtcaccagatggtcaa

SEQ ID NO: 973508 - DNA, 25 bp, Mus musculus
tttgccagtgtctccagatggtcaa

SEQ ID NO: 973509 - DNA, 25 bp, Mus musculus
tttgccagtgtgatttctctcgata

SEQ ID NO: 973510 - DNA, 25 bp, Mus musculus
tttgccagtgtgttttctctcgata

SEQ ID NO: 973511 - DNA, 25 bp, Mus musculus
tttgccagttggacacaggtgaacg

SEQ ID NO: 973512 - DNA, 25 bp, Mus musculus
tttgccagttggtcacaggtgaacg

SEQ ID NO: 973513 - DNA, 25 bp, Mus musculus
tttgccatactgaaaggtgcctacc

SEQ ID NO: 973514 - DNA, 25 bp, Mus musculus
tttgccatactgtaaggtgcctacc

SEQ ID NO: 973515 - DNA, 25 bp, Mus musculus
tttgccatatgtcttttagatttaa

SEQ ID NO: 973516 - DNA, 25 bp, Mus musculus
tttgccatatgtgttttagatttaa

SEQ ID NO: 973517 - DNA, 25 bp, Mus musculus
tttgccatcaaaatcacactttgta

SEQ ID NO: 973518 - DNA, 25 bp, Mus musculus
tttgccatcaaattcacactttgta

SEQ ID NO: 973519 - DNA, 25 bp, Mus musculus
tttgccatcataaacactctgtagt

SEQ ID NO: 973520 - DNA, 25 bp, Mus musculus
tttgccatcatatacactctgtagt

SEQ ID NO: 973521 - DNA, 25 bp, Mus musculus
tttgccatcatgactttcctctgag

SEQ ID NO: 973522 - DNA, 25 bp, Mus musculus
tttgccatcatgtctttcctctgag

SEQ ID NO: 973523 - DNA, 25 bp, Mus musculus
tttgccatcattacctcctgtgagc

SEQ ID NO: 973524 - DNA, 25 bp, Mus musculus
tttgccatcatttcctcctgtgagc

SEQ ID NO: 973525 - DNA, 25 bp, Mus musculus
tttgccatcgtacgtcacagggctc

SEQ ID NO: 973526 - DNA, 25 bp, Mus musculus
tttgccatcgtaggtcacagggctc

SEQ ID NO: 973527 - DNA, 25 bp, Mus musculus
tttgccatctaacattttcttggtt

SEQ ID NO: 973528 - DNA, 25 bp, Mus musculus
tttgccatctaagattttcttggtt

SEQ ID NO: 973529 - DNA, 25 bp, Mus musculus
tttgccatgagaaactctgcagtgt

SEQ ID NO: 973530 - DNA, 25 bp, Mus musculus
tttgccatgagatactctgcagtgt

SEQ ID NO: 973531 - DNA, 25 bp, Mus musculus
tttgccatgcaacatgtgcccctgt

SEQ ID NO: 973532 - DNA, 25 bp, Mus musculus
tttgccatgcaagatgtgcccctgt

SEQ ID NO: 973533 - DNA, 25 bp, Mus musculus
tttgccatgccaatcttttaagaag

SEQ ID NO: 973534 - DNA, 25 bp, Mus musculus
tttgccatgccattcttttaagaag

SEQ ID NO: 973535 - DNA, 25 bp, Mus musculus
tttgccatgcccagcagaaaataaa

SEQ ID NO: 973536 - DNA, 25 bp, Mus musculus
tttgccatgccctgcagaaaataaa

SEQ ID NO: 973537 - DNA, 25 bp, Mus musculus
tttgccatggtgctctttgacttga

SEQ ID NO: 973538 - DNA, 25 bp, Mus musculus
tttgccatggtggtctttgacttga

SEQ ID NO: 973539 - DNA, 25 bp, Mus musculus
tttgccattaacagatgatgccgag

SEQ ID NO: 973540 - DNA, 25 bp, Mus musculus
tttgccattaacctgctgcatgatc

SEQ ID NO: 973541 - DNA, 25 bp, Mus musculus
tttgccattaacgtgctgcatgatc

SEQ ID NO: 973542 - DNA, 25 bp, Mus musculus
tttgccattaactgatgatgccgag

SEQ ID NO: 973543 - DNA, 25 bp, Mus musculus
tttgccattagcaaggttacctctg

SEQ ID NO: 973544 - DNA, 25 bp, Mus musculus
tttgccattagctaggttacctctg

SEQ ID NO: 973545 - DNA, 25 bp, Mus musculus
tttgccattccaatgcttaattatt

SEQ ID NO: 973546 - DNA, 25 bp, Mus musculus
tttgccattccattgcttaattatt

SEQ ID NO: 973547 - DNA, 25 bp, Mus musculus
tttgccattcccagatagctttcct

SEQ ID NO: 973548 - DNA, 25 bp, Mus musculus
tttgccattccctgatagctttcct

SEQ ID NO: 973549 - DNA, 25 bp, Mus musculus
tttgccattcgcacctcttctcttg

SEQ ID NO: 973550 - DNA, 25 bp, Mus musculus
tttgccattcgctcctcttctcttg

SEQ ID NO: 973551 - DNA, 25 bp, Mus musculus
tttgccattgatcaaggtgttccca

SEQ ID NO: 973552 - DNA, 25 bp, Mus musculus
tttgccattgatgaaggtgttccca

SEQ ID NO: 973553 - DNA, 25 bp, Mus musculus
tttgcccaaaataccaaccttgtca

SEQ ID NO: 973554 - DNA, 25 bp, Mus musculus
tttgcccaaaattccaaccttgtca

SEQ ID NO: 973555 - DNA, 25 bp, Mus musculus
tttgcccaaagcctggatgcagaga

SEQ ID NO: 973556 - DNA, 25 bp, Mus musculus
tttgcccaaagcgtggatgcagaga

SEQ ID NO: 973557 - DNA, 25 bp, Mus musculus
tttgcccaatttactatcacttctc

SEQ ID NO: 973558 - DNA, 25 bp, Mus musculus
tttgcccaattttctatcacttctc

SEQ ID NO: 973559 - DNA, 25 bp, Mus musculus
tttgcccacagaccatgctatgtaa

SEQ ID NO: 973560 - DNA, 25 bp, Mus musculus
tttgcccacagagcatgctatgtaa

SEQ ID NO: 973561 - DNA, 25 bp, Mus musculus
tttgcccacatcctttaggtagcct

SEQ ID NO: 973562 - DNA, 25 bp, Mus musculus
tttgcccacatcgtttaggtagcct

SEQ ID NO: 973563 - DNA, 25 bp, Mus musculus
tttgcccaccagacctatatcagcg

SEQ ID NO: 973564 - DNA, 25 bp, Mus musculus
tttgcccaccagtcctatatcagcg

SEQ ID NO: 973565 - DNA, 25 bp, Mus musculus
tttgcccaccttatagtgctgagga

SEQ ID NO: 973566 - DNA, 25 bp, Mus musculus
tttgcccaccttttagtgctgagga

SEQ ID NO: 973567 - DNA, 25 bp, Mus musculus
tttgcccactccacagtttgaatgg

SEQ ID NO: 973568 - DNA, 25 bp, Mus musculus
tttgcccactcctcagtttgaatgg

SEQ ID NO: 973569 - DNA, 25 bp, Mus musculus
tttgcccactgaccggtttttgtga

SEQ ID NO: 973570 - DNA, 25 bp, Mus musculus
tttgcccactgagcggtttttgtga

SEQ ID NO: 973571 - DNA, 25 bp, Mus musculus
tttgcccactgcatctggctgtggg

SEQ ID NO: 973572 - DNA, 25 bp, Mus musculus
tttgcccactgcttctggctgtggg

SEQ ID NO: 973573 - DNA, 25 bp, Mus musculus
tttgcccactgtccaaaggcaggag

SEQ ID NO: 973574 - DNA, 25 bp, Mus musculus
tttgcccactgtgcaaaggcaggag

SEQ ID NO: 973575 - DNA, 25 bp, Mus musculus
tttgcccagaagcacaccaccgtgg

SEQ ID NO: 973576 - DNA, 25 bp, Mus musculus
tttgcccagaaggacaccaccgtgg

SEQ ID NO: 973577 - DNA, 25 bp, Mus musculus
tttgcccagaatctgaagagcccat

SEQ ID NO: 973578 - DNA, 25 bp, Mus musculus
tttgcccagaatgtgaagagcccat

SEQ ID NO: 973579 - DNA, 25 bp, Mus musculus
tttgcccagatcacaacccagattc

SEQ ID NO: 973580 - DNA, 25 bp, Mus musculus
tttgcccagatctcaacccagattc

SEQ ID NO: 973581 - DNA, 25 bp, Mus musculus
tttgcccagcatagcctagacccag

SEQ ID NO: 973582 - DNA, 25 bp, Mus musculus
tttgcccagcattgcctagacccag

SEQ ID NO: 973583 - DNA, 25 bp, Mus musculus
tttgcccagcggcacctctcagaag

SEQ ID NO: 973584 - DNA, 25 bp, Mus musculus
tttgcccagcgggacctctcagaag

SEQ ID NO: 973585 - DNA, 25 bp, Mus musculus
tttgcccagctcacttcgagacttg

SEQ ID NO: 973586 - DNA, 25 bp, Mus musculus
tttgcccagctctcttcgagacttg

SEQ ID NO: 973587 - DNA, 25 bp, Mus musculus
tttgcccaggcacaaggaatgaatg

SEQ ID NO: 973588 - DNA, 25 bp, Mus musculus
tttgcccaggcagaaggaatgaatg

SEQ ID NO: 973589 - DNA, 25 bp, Mus musculus
tttgcccagtccagaaagcactgac

SEQ ID NO: 973590 - DNA, 25 bp, Mus musculus
tttgcccagtcctgaaagcactgac

SEQ ID NO: 973591 - DNA, 25 bp, Mus musculus
tttgcccagttgaaaagcttcagag

SEQ ID NO: 973592 - DNA, 25 bp, Mus musculus
tttgcccagttgtaaagcttcagag

SEQ ID NO: 973593 - DNA, 25 bp, Mus musculus
tttgcccagtttataagcactccgc

SEQ ID NO: 973594 - DNA, 25 bp, Mus musculus
tttgcccagtttttaagcactccgc

SEQ ID NO: 973595 - DNA, 25 bp, Mus musculus
tttgcccataaacaacatgttgctg

SEQ ID NO: 973596 - DNA, 25 bp, Mus musculus
tttgcccataaagaacatgttgctg

SEQ ID NO: 973597 - DNA, 25 bp, Mus musculus
tttgcccatgacatactggctccat

SEQ ID NO: 973598 - DNA, 25 bp, Mus musculus
tttgcccatgacttactggctccat

SEQ ID NO: 973599 - DNA, 25 bp, Mus musculus
tttgcccattttatgttattgttag

SEQ ID NO: 973600 - DNA, 25 bp, Mus musculus
tttgcccattttttgttattgttag

SEQ ID NO: 973601 - DNA, 25 bp, Mus musculus
tttgccccaacgcagacaagcggaa

SEQ ID NO: 973602 - DNA, 25 bp, Mus musculus
tttgccccaacggagacaagcggaa

SEQ ID NO: 973603 - DNA, 25 bp, Mus musculus
tttgccccaagaatgcctgagagaa

SEQ ID NO: 973604 - DNA, 25 bp, Mus musculus
tttgccccaagattgcctgagagaa

SEQ ID NO: 973605 - DNA, 25 bp, Mus musculus
tttgccccagccaatatggttgcta

SEQ ID NO: 973606 - DNA, 25 bp, Mus musculus
tttgccccagcctatatggttgcta

SEQ ID NO: 973607 - DNA, 25 bp, Mus musculus
tttgccccagcgcaggtacgagaag

SEQ ID NO: 973608 - DNA, 25 bp, Mus musculus
tttgccccagcggaggtacgagaag

SEQ ID NO: 973609 - DNA, 25 bp, Mus musculus
tttgccccagctaatgtgttaccaa

SEQ ID NO: 973610 - DNA, 25 bp, Mus musculus
tttgccccagctactcatgtgagtt

SEQ ID NO: 973611 - DNA, 25 bp, Mus musculus
tttgccccagcttatgtgttaccaa

SEQ ID NO: 973612 - DNA, 25 bp, Mus musculus
tttgccccagcttctcatgtgagtt

SEQ ID NO: 973613 - DNA, 25 bp, Mus musculus
tttgccccatgacagtgatcctgtg

SEQ ID NO: 973614 - DNA, 25 bp, Mus musculus
tttgccccatgagagtgatcctgtg

SEQ ID NO: 973615 - DNA, 25 bp, Mus musculus
tttgccccattcaacatctgacttg

SEQ ID NO: 973616 - DNA, 25 bp, Mus musculus
tttgccccattctacatctgacttg

SEQ ID NO: 973617 - DNA, 25 bp, Mus musculus
tttgccccgggcatactgtaccaac

SEQ ID NO: 973618 - DNA, 25 bp, Mus musculus
tttgccccgggcttactgtaccaac

SEQ ID NO: 973619 - DNA, 25 bp, Mus musculus
tttgccccgtgcattggtcagcatg

SEQ ID NO: 973620 - DNA, 25 bp, Mus musculus
tttgccccgtgctttggtcagcatg

SEQ ID NO: 973621 - DNA, 25 bp, Mus musculus
tttgccccgtttccatttcaatcag

SEQ ID NO: 973622 - DNA, 25 bp, Mus musculus
tttgccccgtttgcatttcaatcag

SEQ ID NO: 973623 - DNA, 25 bp, Mus musculus
tttgcccctaagacatgtaccacag

SEQ ID NO: 973624 - DNA, 25 bp, Mus musculus
tttgcccctaagtcatgtaccacag

SEQ ID NO: 973625 - DNA, 25 bp, Mus musculus
tttgcccctctgagcataagatgct

SEQ ID NO: 973626 - DNA, 25 bp, Mus musculus
tttgcccctctgtgcataagatgct

SEQ ID NO: 973627 - DNA, 25 bp, Mus musculus
tttgcccctgggaagagcttccaac

SEQ ID NO: 973628 - DNA, 25 bp, Mus musculus
tttgcccctgggtagagcttccaac

SEQ ID NO: 973629 - DNA, 25 bp, Mus musculus
tttgcccctgtacattttgaatctt

SEQ ID NO: 973630 - DNA, 25 bp, Mus musculus
tttgcccctgtagattttgaatctt

SEQ ID NO: 973631 - DNA, 25 bp, Mus musculus
tttgcccctgtgcttagaccaactc

SEQ ID NO: 973632 - DNA, 25 bp, Mus musculus
tttgcccctgtggttagaccaactc

SEQ ID NO: 973633 - DNA, 25 bp, Mus musculus
tttgcccctttaagcttacacctga

SEQ ID NO: 973634 - DNA, 25 bp, Mus musculus
tttgcccctttatgcttacacctga

SEQ ID NO: 973635 - DNA, 25 bp, Mus musculus
tttgcccgagacaataatcttgctg

SEQ ID NO: 973636 - DNA, 25 bp, Mus musculus
tttgcccgagactataatcttgctg

SEQ ID NO: 973637 - DNA, 25 bp, Mus musculus
tttgcccgatgaacttaccttacac

SEQ ID NO: 973638 - DNA, 25 bp, Mus musculus
tttgcccgatgatcttaccttacac

SEQ ID NO: 973639 - DNA, 25 bp, Mus musculus
tttgcccgcaggatctgaacaactg

SEQ ID NO: 973640 - DNA, 25 bp, Mus musculus
tttgcccgcaggttctgaacaactg

SEQ ID NO: 973641 - DNA, 25 bp, Mus musculus
tttgcccgggaaagactagcagcca

SEQ ID NO: 973642 - DNA, 25 bp, Mus musculus
tttgcccgggaatgactagcagcca

SEQ ID NO: 973643 - DNA, 25 bp, Mus musculus
tttgcccgggataagattcagagtt

SEQ ID NO: 973644 - DNA, 25 bp, Mus musculus
tttgcccgggattagattcagagtt

SEQ ID NO: 973645 - DNA, 25 bp, Mus musculus
tttgcccgggtgcaagctgagttac

SEQ ID NO: 973646 - DNA, 25 bp, Mus musculus
tttgcccgggtggaagctgagttac

SEQ ID NO: 973647 - DNA, 25 bp, Mus musculus
tttgccctaaaaatcctgggcaggc

SEQ ID NO: 973648 - DNA, 25 bp, Mus musculus
tttgccctaaaattcctgggcaggc

SEQ ID NO: 973649 - DNA, 25 bp, Mus musculus
tttgccctacaaccatggcattgca

SEQ ID NO: 973650 - DNA, 25 bp, Mus musculus
tttgccctacaagcatggcattgca

SEQ ID NO: 973651 - DNA, 25 bp, Mus musculus
tttgccctacagaaccctggtgttg

SEQ ID NO: 973652 - DNA, 25 bp, Mus musculus
tttgccctacagtaccctggtgttg

SEQ ID NO: 973653 - DNA, 25 bp, Mus musculus
tttgccctagttcctgctcttagcc

SEQ ID NO: 973654 - DNA, 25 bp, Mus musculus
tttgccctagttgctgctcttagcc

SEQ ID NO: 973655 - DNA, 25 bp, Mus musculus
tttgccctatgaccagccaatgaga

SEQ ID NO: 973656 - DNA, 25 bp, Mus musculus
tttgccctatgagcagccaatgaga

SEQ ID NO: 973657 - DNA, 25 bp, Mus musculus
tttgccctccaaactacgtagatga

SEQ ID NO: 973658 - DNA, 25 bp, Mus musculus
tttgccctccaatctacgtagatga

SEQ ID NO: 973659 - DNA, 25 bp, Mus musculus
tttgccctcctcatcagctagggct

SEQ ID NO: 973660 - DNA, 25 bp, Mus musculus
tttgccctcctcttcagctagggct

SEQ ID NO: 973661 - DNA, 25 bp, Mus musculus
tttgccctctatctactcagtgtgg

SEQ ID NO: 973662 - DNA, 25 bp, Mus musculus
tttgccctctatgtactcagtgtgg

SEQ ID NO: 973663 - DNA, 25 bp, Mus musculus
tttgccctctcccttgcattcatat

SEQ ID NO: 973664 - DNA, 25 bp, Mus musculus
tttgccctctccgttgcattcatat

SEQ ID NO: 973665 - DNA, 25 bp, Mus musculus
tttgccctcttgagttgtctcaaca

SEQ ID NO: 973666 - DNA, 25 bp, Mus musculus
tttgccctcttgtgttgtctcaaca

SEQ ID NO: 973667 - DNA, 25 bp, Mus musculus
tttgccctgaagatttagaaaacag

SEQ ID NO: 973668 - DNA, 25 bp, Mus musculus
tttgccctgaagttttagaaaacag

SEQ ID NO: 973669 - DNA, 25 bp, Mus musculus
tttgccctgggcacaggactacgag

SEQ ID NO: 973670 - DNA, 25 bp, Mus musculus
tttgccctgggctcaggactacgag

SEQ ID NO: 973671 - DNA, 25 bp, Mus musculus
tttgccctgggtcctccagagacag

SEQ ID NO: 973672 - DNA, 25 bp, Mus musculus
tttgccctgggtgctccagagacag

SEQ ID NO: 973673 - DNA, 25 bp, Mus musculus
tttgccctgtagctgcatcattgtc

SEQ ID NO: 973674 - DNA, 25 bp, Mus musculus
tttgccctgtaggtgcatcattgtc

SEQ ID NO: 973675 - DNA, 25 bp, Mus musculus
tttgccctgtgcactagcagaggca

SEQ ID NO: 973676 - DNA, 25 bp, Mus musculus
tttgccctgtgcagtgggtacatgg

SEQ ID NO: 973677 - DNA, 25 bp, Mus musculus
tttgccctgtgctctagcagaggca

SEQ ID NO: 973678 - DNA, 25 bp, Mus musculus
tttgccctgtgctgtgggtacatgg

SEQ ID NO: 973679 - DNA, 25 bp, Mus musculus
tttgccctgttgacttcaaggtcca

SEQ ID NO: 973680 - DNA, 25 bp, Mus musculus
tttgccctgttgtcttcaaggtcca

SEQ ID NO: 973681 - DNA, 25 bp, Mus musculus
tttgcccttatgaggagaggccctt

SEQ ID NO: 973682 - DNA, 25 bp, Mus musculus
tttgcccttatgtggagaggccctt

SEQ ID NO: 973683 - DNA, 25 bp, Mus musculus
tttgcccttcagagctgcctttgct

SEQ ID NO: 973684 - DNA, 25 bp, Mus musculus
tttgcccttcagtgctgcctttgct

SEQ ID NO: 973685 - DNA, 25 bp, Mus musculus
tttgcccttccaaacctttctgttt

SEQ ID NO: 973686 - DNA, 25 bp, Mus musculus
tttgcccttccatacctttctgttt

SEQ ID NO: 973687 - DNA, 25 bp, Mus musculus
tttgcccttccgagaaggtggaagg

SEQ ID NO: 973688 - DNA, 25 bp, Mus musculus
tttgcccttccgtgaaggtggaagg

SEQ ID NO: 973689 - DNA, 25 bp, Mus musculus
tttgcccttctaaatccttcttgat

SEQ ID NO: 973690 - DNA, 25 bp, Mus musculus
tttgcccttctatatccttcttgat

SEQ ID NO: 973691 - DNA, 25 bp, Mus musculus
tttgcccttcttattcttcataatt

SEQ ID NO: 973692 - DNA, 25 bp, Mus musculus
tttgcccttctttttcttcataatt

SEQ ID NO: 973693 - DNA, 25 bp, Mus musculus
tttgcccttgcaactgtcatttctg

SEQ ID NO: 973694 - DNA, 25 bp, Mus musculus
tttgcccttgcatctgtcatttctg

SEQ ID NO: 973695 - DNA, 25 bp, Mus musculus
tttgcccttggtctaaatcacccag

SEQ ID NO: 973696 - DNA, 25 bp, Mus musculus
tttgcccttggtgtaaatcacccag

SEQ ID NO: 973697 - DNA, 25 bp, Mus musculus
tttgcccttgtaatgctttttgtta

SEQ ID NO: 973698 - DNA, 25 bp, Mus musculus
tttgcccttgtattgctttttgtta

SEQ ID NO: 973699 - DNA, 25 bp, Mus musculus
tttgcccttgtgcaagtatgtgact

SEQ ID NO: 973700 - DNA, 25 bp, Mus musculus
tttgcccttgtggaagtatgtgact

SEQ ID NO: 973701 - DNA, 25 bp, Mus musculus
tttgccctttataggctccttgaag

SEQ ID NO: 973702 - DNA, 25 bp, Mus musculus
tttgccctttattggctccttgaag

SEQ ID NO: 973703 - DNA, 25 bp, Mus musculus
tttgccctttctcctagagttattt

SEQ ID NO: 973704 - DNA, 25 bp, Mus musculus
tttgccctttctgctagagttattt

SEQ ID NO: 973705 - DNA, 25 bp, Mus musculus
tttgccctttgtctctgtggctaaa

SEQ ID NO: 973706 - DNA, 25 bp, Mus musculus
tttgccctttgtgtctgtggctaaa

SEQ ID NO: 973707 - DNA, 25 bp, Mus musculus
tttgccctttttcaagttgcttctc

SEQ ID NO: 973708 - DNA, 25 bp, Mus musculus
tttgccctttttgaagttgcttctc

SEQ ID NO: 973709 - DNA, 25 bp, Mus musculus
tttgccgaaaccagtggaagccttt

SEQ ID NO: 973710 - DNA, 25 bp, Mus musculus
tttgccgaaacctgtggaagccttt

SEQ ID NO: 973711 - DNA, 25 bp, Mus musculus
tttgccgacaccatttatgctgtct

SEQ ID NO: 973712 - DNA, 25 bp, Mus musculus
tttgccgacaccttttatgctgtct

SEQ ID NO: 973713 - DNA, 25 bp, Mus musculus
tttgccgagagcaagagccctgcat

SEQ ID NO: 973714 - DNA, 25 bp, Mus musculus
tttgccgagagctagagccctgcat

SEQ ID NO: 973715 - DNA, 25 bp, Mus musculus
tttgccgagcagacttttgcagagc

SEQ ID NO: 973716 - DNA, 25 bp, Mus musculus
tttgccgagcagtcttttgcagagc

SEQ ID NO: 973717 - DNA, 25 bp, Mus musculus
tttgccgaggaaactgtactgcgcc

SEQ ID NO: 973718 - DNA, 25 bp, Mus musculus
tttgccgaggaatctgtactgcgcc

SEQ ID NO: 973719 - DNA, 25 bp, Mus musculus
tttgccgatatcatgtacatttagc

SEQ ID NO: 973720 - DNA, 25 bp, Mus musculus
tttgccgatatcttgtacatttagc

SEQ ID NO: 973721 - DNA, 25 bp, Mus musculus
tttgccgatttgcacattaaatgac

SEQ ID NO: 973722 - DNA, 25 bp, Mus musculus
tttgccgatttggacattaaatgac

SEQ ID NO: 973723 - DNA, 25 bp, Mus musculus
tttgccgctcaaactgacagtctat

SEQ ID NO: 973724 - DNA, 25 bp, Mus musculus
tttgccgctcaatctgacagtctat

SEQ ID NO: 973725 - DNA, 25 bp, Mus musculus
tttgccgctgtactatccgaaaact

SEQ ID NO: 973726 - DNA, 25 bp, Mus musculus
tttgccgctgtagtatccgaaaact

SEQ ID NO: 973727 - DNA, 25 bp, Mus musculus
tttgccgcttccaggtttggaacta

SEQ ID NO: 973728 - DNA, 25 bp, Mus musculus
tttgccgcttcctggtttggaacta

SEQ ID NO: 973729 - DNA, 25 bp, Mus musculus
tttgccggcaaaccagctcagtacc

SEQ ID NO: 973730 - DNA, 25 bp, Mus musculus
tttgccggcaaagcagctcagtacc

SEQ ID NO: 973731 - DNA, 25 bp, Mus musculus
tttgccggtcacctgttattcgtca

SEQ ID NO: 973732 - DNA, 25 bp, Mus musculus
tttgccggtcacgtgttattcgtca

SEQ ID NO: 973733 - DNA, 25 bp, Mus musculus
tttgccgtagtcaactaaccgcata

SEQ ID NO: 973734 - DNA, 25 bp, Mus musculus
tttgccgtagtctactaaccgcata

SEQ ID NO: 973735 - DNA, 25 bp, Mus musculus
tttgccgtattcagtgtctcttctt

SEQ ID NO: 973736 - DNA, 25 bp, Mus musculus
tttgccgtattctgtgtctcttctt

SEQ ID NO: 973737 - DNA, 25 bp, Mus musculus
tttgccgtgaacacattcaaccagg

SEQ ID NO: 973738 - DNA, 25 bp, Mus musculus
tttgccgtgaactcattcaaccagg

SEQ ID NO: 973739 - DNA, 25 bp, Mus musculus
tttgccgtggtgatgctctgcagca

SEQ ID NO: 973740 - DNA, 25 bp, Mus musculus
tttgccgtggtgttgctctgcagca

SEQ ID NO: 973741 - DNA, 25 bp, Mus musculus
tttgccgttggtacacaatgtcatc

SEQ ID NO: 973742 - DNA, 25 bp, Mus musculus
tttgccgttggttcacaatgtcatc

SEQ ID NO: 973743 - DNA, 25 bp, Mus musculus
tttgcctaaaaactgagcccagaaa

SEQ ID NO: 973744 - DNA, 25 bp, Mus musculus
tttgcctaaaaagtgagcccagaaa

SEQ ID NO: 973745 - DNA, 25 bp, Mus musculus
tttgcctacaacctctgagagcctg

SEQ ID NO: 973746 - DNA, 25 bp, Mus musculus
tttgcctacaacgtctgagagcctg

SEQ ID NO: 973747 - DNA, 25 bp, Mus musculus
tttgcctacagaccacattgctcat

SEQ ID NO: 973748 - DNA, 25 bp, Mus musculus
tttgcctacagagcacattgctcat

SEQ ID NO: 973749 - DNA, 25 bp, Mus musculus
tttgcctacataagtcagtcccttt

SEQ ID NO: 973750 - DNA, 25 bp, Mus musculus
tttgcctacatatgtcagtcccttt

SEQ ID NO: 973751 - DNA, 25 bp, Mus musculus
tttgcctactctcaagatggttctt

SEQ ID NO: 973752 - DNA, 25 bp, Mus musculus
tttgcctactctgaagatggttctt

SEQ ID NO: 973753 - DNA, 25 bp, Mus musculus
tttgcctaggctcttagcccactct

SEQ ID NO: 973754 - DNA, 25 bp, Mus musculus
tttgcctaggctgttagcccactct

SEQ ID NO: 973755 - DNA, 25 bp, Mus musculus
tttgcctaggtcaccagagcttggt

SEQ ID NO: 973756 - DNA, 25 bp, Mus musculus
tttgcctaggtctccagagcttggt

SEQ ID NO: 973757 - DNA, 25 bp, Mus musculus
tttgcctagtgcagggagccatctc

SEQ ID NO: 973758 - DNA, 25 bp, Mus musculus
tttgcctagtgctgggagccatctc

SEQ ID NO: 973759 - DNA, 25 bp, Mus musculus
tttgcctagtgtccctaaggcctag

SEQ ID NO: 973760 - DNA, 25 bp, Mus musculus
tttgcctagtgtgcctaaggcctag

SEQ ID NO: 973761 - DNA, 25 bp, Mus musculus
tttgcctatttcagatctttccagt

SEQ ID NO: 973762 - DNA, 25 bp, Mus musculus
tttgcctatttctgatctttccagt

SEQ ID NO: 973763 - DNA, 25 bp, Mus musculus
tttgcctcaaccatatagatgctgt

SEQ ID NO: 973764 - DNA, 25 bp, Mus musculus
tttgcctcaaccttatagatgctgt

SEQ ID NO: 973765 - DNA, 25 bp, Mus musculus
tttgcctcagcaaggcgcagcctag

SEQ ID NO: 973766 - DNA, 25 bp, Mus musculus
tttgcctcagcatggcgcagcctag

SEQ ID NO: 973767 - DNA, 25 bp, Mus musculus
tttgcctcagcgcatatgtttatac

SEQ ID NO: 973768 - DNA, 25 bp, Mus musculus
tttgcctcagcggatatgtttatac

SEQ ID NO: 973769 - DNA, 25 bp, Mus musculus
tttgcctcatatataagctgctgct

SEQ ID NO: 973770 - DNA, 25 bp, Mus musculus
tttgcctcatatttaagctgctgct

SEQ ID NO: 973771 - DNA, 25 bp, Mus musculus
tttgcctcatgactagtcctgtagt

SEQ ID NO: 973772 - DNA, 25 bp, Mus musculus
tttgcctcatgagtagtcctgtagt

SEQ ID NO: 973773 - DNA, 25 bp, Mus musculus
tttgcctcccggaattccattattc

SEQ ID NO: 973774 - DNA, 25 bp, Mus musculus
tttgcctcccggtattccattattc

SEQ ID NO: 973775 - DNA, 25 bp, Mus musculus
tttgcctcccttcagaaatacttgg

SEQ ID NO: 973776 - DNA, 25 bp, Mus musculus
tttgcctcccttgagaaatacttgg

SEQ ID NO: 973777 - DNA, 25 bp, Mus musculus
tttgcctcctctaacatgcaggtag

SEQ ID NO: 973778 - DNA, 25 bp, Mus musculus
tttgcctcctcttacatgcaggtag

SEQ ID NO: 973779 - DNA, 25 bp, Mus musculus
tttgcctcctgaaagccactctgta

SEQ ID NO: 973780 - DNA, 25 bp, Mus musculus
tttgcctcctgatagccactctgta

SEQ ID NO: 973781 - DNA, 25 bp, Mus musculus
tttgcctcgactatggagcttcatg

SEQ ID NO: 973782 - DNA, 25 bp, Mus musculus
tttgcctcgactttggagcttcatg

SEQ ID NO: 973783 - DNA, 25 bp, Mus musculus
tttgcctcgtgcattctgcaatgtt

SEQ ID NO: 973784 - DNA, 25 bp, Mus musculus
tttgcctcgtgctttctgcaatgtt

SEQ ID NO: 973785 - DNA, 25 bp, Mus musculus
tttgcctctcagcaagtcctacaat

SEQ ID NO: 973786 - DNA, 25 bp, Mus musculus
tttgcctctcaggaagtcctacaat

SEQ ID NO: 973787 - DNA, 25 bp, Mus musculus
tttgcctctcatagtatcttgcaga

SEQ ID NO: 973788 - DNA, 25 bp, Mus musculus
tttgcctctcattgtatcttgcaga

SEQ ID NO: 973789 - DNA, 25 bp, Mus musculus
tttgcctctctaagtttaaagacga

SEQ ID NO: 973790 - DNA, 25 bp, Mus musculus
tttgcctctctatgtttaaagacga

SEQ ID NO: 973791 - DNA, 25 bp, Mus musculus
tttgcctctcttccatatgctaaag

SEQ ID NO: 973792 - DNA, 25 bp, Mus musculus
tttgcctctcttgcatatgctaaag

SEQ ID NO: 973793 - DNA, 25 bp, Mus musculus
tttgcctctgacagggcaactgtaa

SEQ ID NO: 973794 - DNA, 25 bp, Mus musculus
tttgcctctgactgggcaactgtaa

SEQ ID NO: 973795 - DNA, 25 bp, Mus musculus
tttgcctctgcaatggattgcttgc

SEQ ID NO: 973796 - DNA, 25 bp, Mus musculus
tttgcctctgcattggattgcttgc

SEQ ID NO: 973797 - DNA, 25 bp, Mus musculus
tttgcctctggaatagtctcctccg

SEQ ID NO: 973798 - DNA, 25 bp, Mus musculus
tttgcctctggaatgttgcccaggt

SEQ ID NO: 973799 - DNA, 25 bp, Mus musculus
tttgcctctggattagtctcctccg

SEQ ID NO: 973800 - DNA, 25 bp, Mus musculus
tttgcctctggattgttgcccaggt

SEQ ID NO: 973801 - DNA, 25 bp, Mus musculus
tttgcctctggcatgcaggaagact

SEQ ID NO: 973802 - DNA, 25 bp, Mus musculus
tttgcctctggcttgcaggaagact

SEQ ID NO: 973803 - DNA, 25 bp, Mus musculus
tttgcctctgggaagaccgcggagt

SEQ ID NO: 973804 - DNA, 25 bp, Mus musculus
tttgcctctgggatctactgtgcac

SEQ ID NO: 973805 - DNA, 25 bp, Mus musculus
tttgcctctgggattacacagccac

SEQ ID NO: 973806 - DNA, 25 bp, Mus musculus
tttgcctctgggtagaccgcggagt

SEQ ID NO: 973807 - DNA, 25 bp, Mus musculus
tttgcctctgggttctactgtgcac

SEQ ID NO: 973808 - DNA, 25 bp, Mus musculus
tttgcctctgggtttacacagccac

SEQ ID NO: 973809 - DNA, 25 bp, Mus musculus
tttgcctctgtccatgacgctgtga

SEQ ID NO: 973810 - DNA, 25 bp, Mus musculus
tttgcctctgtcgatgacgctgtga

SEQ ID NO: 973811 - DNA, 25 bp, Mus musculus
tttgcctcttatacagccatggtgc

SEQ ID NO: 973812 - DNA, 25 bp, Mus musculus
tttgcctcttattcagccatggtgc

SEQ ID NO: 973813 - DNA, 25 bp, Mus musculus
tttgcctgaagaacctgcaacaaga

SEQ ID NO: 973814 - DNA, 25 bp, Mus musculus
tttgcctgaagatcctgcaacaaga

SEQ ID NO: 973815 - DNA, 25 bp, Mus musculus
tttgcctgaataagaagatttggga

SEQ ID NO: 973816 - DNA, 25 bp, Mus musculus
tttgcctgaatatgaagatttggga

SEQ ID NO: 973817 - DNA, 25 bp, Mus musculus
tttgcctgaatgaccaggttgtgac

SEQ ID NO: 973818 - DNA, 25 bp, Mus musculus
tttgcctgaatgtccaggttgtgac

SEQ ID NO: 973819 - DNA, 25 bp, Mus musculus
tttgcctgagcaatcctttttataa

SEQ ID NO: 973820 - DNA, 25 bp, Mus musculus
tttgcctgagcattcctttttataa

SEQ ID NO: 973821 - DNA, 25 bp, Mus musculus
tttgcctgagccatttttgggctcc

SEQ ID NO: 973822 - DNA, 25 bp, Mus musculus
tttgcctgagccttttttgggctcc

SEQ ID NO: 973823 - DNA, 25 bp, Mus musculus
tttgcctgcagcatttacttaaccc

SEQ ID NO: 973824 - DNA, 25 bp, Mus musculus
tttgcctgcagcttttacttaaccc

SEQ ID NO: 973825 - DNA, 25 bp, Mus musculus
tttgcctgccacattgcaggtccaa

SEQ ID NO: 973826 - DNA, 25 bp, Mus musculus
tttgcctgccactttgcaggtccaa

SEQ ID NO: 973827 - DNA, 25 bp, Mus musculus
tttgcctgcggcaccttatctggct

SEQ ID NO: 973828 - DNA, 25 bp, Mus musculus
tttgcctgcggctccttatctggct

SEQ ID NO: 973829 - DNA, 25 bp, Mus musculus
tttgcctgcgtaatcacacacagtg

SEQ ID NO: 973830 - DNA, 25 bp, Mus musculus
tttgcctgcgtattcacacacagtg

SEQ ID NO: 973831 - DNA, 25 bp, Mus musculus
tttgcctgctcccttttctgttcca

SEQ ID NO: 973832 - DNA, 25 bp, Mus musculus
tttgcctgctccgttttctgttcca

SEQ ID NO: 973833 - DNA, 25 bp, Mus musculus
tttgcctgctctctggagcagacat

SEQ ID NO: 973834 - DNA, 25 bp, Mus musculus
tttgcctgctctgtggagcagacat

SEQ ID NO: 973835 - DNA, 25 bp, Mus musculus
tttgcctgtaagatccctaggacat

SEQ ID NO: 973836 - DNA, 25 bp, Mus musculus
tttgcctgtaagttccctaggacat

SEQ ID NO: 973837 - DNA, 25 bp, Mus musculus
tttgcctgtaggaatggctaacata

SEQ ID NO: 973838 - DNA, 25 bp, Mus musculus
tttgcctgtaggtatggctaacata

SEQ ID NO: 973839 - DNA, 25 bp, Mus musculus
tttgcctgtataaggagaaattgaa

SEQ ID NO: 973840 - DNA, 25 bp, Mus musculus
tttgcctgtatatggagaaattgaa

SEQ ID NO: 973841 - DNA, 25 bp, Mus musculus
tttgcctgtatgagagatatgttct

SEQ ID NO: 973842 - DNA, 25 bp, Mus musculus
tttgcctgtatgtgagatatgttct

SEQ ID NO: 973843 - DNA, 25 bp, Mus musculus
tttgcctgtattactgtctgtgtgc

SEQ ID NO: 973844 - DNA, 25 bp, Mus musculus
tttgcctgtattagaaattgtgata

SEQ ID NO: 973845 - DNA, 25 bp, Mus musculus
tttgcctgtatttctgtctgtgtgc

SEQ ID NO: 973846 - DNA, 25 bp, Mus musculus
tttgcctgtatttgaaattgtgata

SEQ ID NO: 973847 - DNA, 25 bp, Mus musculus
tttgcctgtgcaaatgacccatgta

SEQ ID NO: 973848 - DNA, 25 bp, Mus musculus
tttgcctgtgcatatgacccatgta

SEQ ID NO: 973849 - DNA, 25 bp, Mus musculus
tttgcctgtttactttgtaggtttg

SEQ ID NO: 973850 - DNA, 25 bp, Mus musculus
tttgcctgtttagtttgtaggtttg

SEQ ID NO: 973851 - DNA, 25 bp, Mus musculus
tttgcctgtttcactgggattgtca

SEQ ID NO: 973852 - DNA, 25 bp, Mus musculus
tttgcctgtttctctgggattgtca

SEQ ID NO: 973853 - DNA, 25 bp, Mus musculus
tttgccttaaataagctcactctcc

SEQ ID NO: 973854 - DNA, 25 bp, Mus musculus
tttgccttaaattagctcactctcc

SEQ ID NO: 973855 - DNA, 25 bp, Mus musculus
tttgccttaatccttttgaacaatg

SEQ ID NO: 973856 - DNA, 25 bp, Mus musculus
tttgccttaatcgttttgaacaatg

SEQ ID NO: 973857 - DNA, 25 bp, Mus musculus
tttgccttaattcttacctcatttg

SEQ ID NO: 973858 - DNA, 25 bp, Mus musculus
tttgccttaattgttacctcatttg

SEQ ID NO: 973859 - DNA, 25 bp, Mus musculus
tttgccttagcaatctcacaactct

SEQ ID NO: 973860 - DNA, 25 bp, Mus musculus
tttgccttagcattctcacaactct

SEQ ID NO: 973861 - DNA, 25 bp, Mus musculus
tttgccttatgaacgtgcactgtaa

SEQ ID NO: 973862 - DNA, 25 bp, Mus musculus
tttgccttatgaattgtgccgtgtc

SEQ ID NO: 973863 - DNA, 25 bp, Mus musculus
tttgccttatgatcgtgcactgtaa

SEQ ID NO: 973864 - DNA, 25 bp, Mus musculus
tttgccttatgatttgtgccgtgtc

SEQ ID NO: 973865 - DNA, 25 bp, Mus musculus
tttgccttcaacaccatgcacacgt

SEQ ID NO: 973866 - DNA, 25 bp, Mus musculus
tttgccttcaactccatgcacacgt

SEQ ID NO: 973867 - DNA, 25 bp, Mus musculus
tttgccttcagacccacatctttct

SEQ ID NO: 973868 - DNA, 25 bp, Mus musculus
tttgccttcagagccacatctttct

SEQ ID NO: 973869 - DNA, 25 bp, Mus musculus
tttgccttcatgatatacatttatg

SEQ ID NO: 973870 - DNA, 25 bp, Mus musculus
tttgccttcatgttatacatttatg

SEQ ID NO: 973871 - DNA, 25 bp, Mus musculus
tttgccttcattatctagcttcagt

SEQ ID NO: 973872 - DNA, 25 bp, Mus musculus
tttgccttcattttctagcttcagt

SEQ ID NO: 973873 - DNA, 25 bp, Mus musculus
tttgccttcccaccgtctgttgtta

SEQ ID NO: 973874 - DNA, 25 bp, Mus musculus
tttgccttcccagcgtctgttgtta

SEQ ID NO: 973875 - DNA, 25 bp, Mus musculus
tttgccttccgacgtcaaccaggtc

SEQ ID NO: 973876 - DNA, 25 bp, Mus musculus
tttgccttccgaggtcaaccaggtc

SEQ ID NO: 973877 - DNA, 25 bp, Mus musculus
tttgccttcctaacttagcatctgg

SEQ ID NO: 973878 - DNA, 25 bp, Mus musculus
tttgccttcctatcttagcatctgg

SEQ ID NO: 973879 - DNA, 25 bp, Mus musculus
tttgccttcctcaaatgacctaaaa

SEQ ID NO: 973880 - DNA, 25 bp, Mus musculus
tttgccttcctctaatgacctaaaa

SEQ ID NO: 973881 - DNA, 25 bp, Mus musculus
tttgccttcgtaatgctttcagtga

SEQ ID NO: 973882 - DNA, 25 bp, Mus musculus
tttgccttcgtattgctttcagtga

SEQ ID NO: 973883 - DNA, 25 bp, Mus musculus
tttgccttctcactactcagagtaa

SEQ ID NO: 973884 - DNA, 25 bp, Mus musculus
tttgccttctcactcttggtggtag

SEQ ID NO: 973885 - DNA, 25 bp, Mus musculus
tttgccttctcagtactcagagtaa

SEQ ID NO: 973886 - DNA, 25 bp, Mus musculus
tttgccttctcagtcttggtggtag

SEQ ID NO: 973887 - DNA, 25 bp, Mus musculus
tttgccttcttactcctggaatcaa

SEQ ID NO: 973888 - DNA, 25 bp, Mus musculus
tttgccttcttagtcctggaatcaa

SEQ ID NO: 973889 - DNA, 25 bp, Mus musculus
tttgccttcttcaactaggatttcc

SEQ ID NO: 973890 - DNA, 25 bp, Mus musculus
tttgccttcttcaccaaagccagtg

SEQ ID NO: 973891 - DNA, 25 bp, Mus musculus
tttgccttcttctactaggatttcc

SEQ ID NO: 973892 - DNA, 25 bp, Mus musculus
tttgccttcttctccaaagccagtg

SEQ ID NO: 973893 - DNA, 25 bp, Mus musculus
tttgccttctttatgctcatgttaa

SEQ ID NO: 973894 - DNA, 25 bp, Mus musculus
tttgccttctttttgctcatgttaa

SEQ ID NO: 973895 - DNA, 25 bp, Mus musculus
tttgccttgaacatgaaccactagt

SEQ ID NO: 973896 - DNA, 25 bp, Mus musculus
tttgccttgaacttgaaccactagt

SEQ ID NO: 973897 - DNA, 25 bp, Mus musculus
tttgccttgagcactagcagaagca

SEQ ID NO: 973898 - DNA, 25 bp, Mus musculus
tttgccttgagctctagcagaagca

SEQ ID NO: 973899 - DNA, 25 bp, Mus musculus
tttgccttgagtatctcatctgcaa

SEQ ID NO: 973900 - DNA, 25 bp, Mus musculus
tttgccttgagtttctcatctgcaa

SEQ ID NO: 973901 - DNA, 25 bp, Mus musculus
tttgccttgccaagtctaacaactt

SEQ ID NO: 973902 - DNA, 25 bp, Mus musculus
tttgccttgccatgtctaacaactt

SEQ ID NO: 973903 - DNA, 25 bp, Mus musculus
tttgccttgcttaagactcctgtat

SEQ ID NO: 973904 - DNA, 25 bp, Mus musculus
tttgccttgctttagactcctgtat

SEQ ID NO: 973905 - DNA, 25 bp, Mus musculus
tttgccttggagatgatcacctgct

SEQ ID NO: 973906 - DNA, 25 bp, Mus musculus
tttgccttggagttgatcacctgct

SEQ ID NO: 973907 - DNA, 25 bp, Mus musculus
tttgcctttattagaaacctgttct

SEQ ID NO: 973908 - DNA, 25 bp, Mus musculus
tttgcctttatttgaaacctgttct

SEQ ID NO: 973909 - DNA, 25 bp, Mus musculus
tttgcctttcccaaaatggtatgtt

SEQ ID NO: 973910 - DNA, 25 bp, Mus musculus
tttgcctttccctaaatggtatgtt

SEQ ID NO: 973911 - DNA, 25 bp, Mus musculus
tttgcctttcctctacctttcagag

SEQ ID NO: 973912 - DNA, 25 bp, Mus musculus
tttgcctttcctgtacctttcagag

SEQ ID NO: 973913 - DNA, 25 bp, Mus musculus
tttgcctttctgagagtgtgtaatc

SEQ ID NO: 973914 - DNA, 25 bp, Mus musculus
tttgcctttctgataacaatttcaa

SEQ ID NO: 973915 - DNA, 25 bp, Mus musculus
tttgcctttctgtgagtgtgtaatc

SEQ ID NO: 973916 - DNA, 25 bp, Mus musculus
tttgcctttctgttaacaatttcaa

SEQ ID NO: 973917 - DNA, 25 bp, Mus musculus
tttgcctttcttagatcaccgtcta

SEQ ID NO: 973918 - DNA, 25 bp, Mus musculus
tttgcctttctttgatcaccgtcta

SEQ ID NO: 973919 - DNA, 25 bp, Mus musculus
tttgcctttgacaccctgacttcaa

SEQ ID NO: 973920 - DNA, 25 bp, Mus musculus
tttgcctttgactccctgacttcaa

SEQ ID NO: 973921 - DNA, 25 bp, Mus musculus
tttgcctttgctatgatcttctgtt

SEQ ID NO: 973922 - DNA, 25 bp, Mus musculus
tttgcctttgctttgatcttctgtt

SEQ ID NO: 973923 - DNA, 25 bp, Mus musculus
tttgcctttggcagttgctgaagaa

SEQ ID NO: 973924 - DNA, 25 bp, Mus musculus
tttgcctttggctgttgctgaagaa

SEQ ID NO: 973925 - DNA, 25 bp, Mus musculus
tttgccttttttcatcagttaaaat

SEQ ID NO: 973926 - DNA, 25 bp, Mus musculus
tttgccttttttgatcagttaaaat

SEQ ID NO: 973927 - DNA, 25 bp, Mus musculus
tttgcgaacagcaggtcacaggtct

SEQ ID NO: 973928 - DNA, 25 bp, Mus musculus
tttgcgaacagctggtcacaggtct

SEQ ID NO: 973929 - DNA, 25 bp, Mus musculus
tttgcgaacttaccaggtccctgtt

SEQ ID NO: 973930 - DNA, 25 bp, Mus musculus
tttgcgaacttagcaggtccctgtt

SEQ ID NO: 973931 - DNA, 25 bp, Mus musculus
tttgcgaatgctagaaactggctgc

SEQ ID NO: 973932 - DNA, 25 bp, Mus musculus
tttgcgaatgcttgaaactggctgc

SEQ ID NO: 973933 - DNA, 25 bp, Mus musculus
tttgcgacagagagctgccaacttt

SEQ ID NO: 973934 - DNA, 25 bp, Mus musculus
tttgcgacagagtgctgccaacttt

SEQ ID NO: 973935 - DNA, 25 bp, Mus musculus
tttgcgaggaggaggttataaccct

SEQ ID NO: 973936 - DNA, 25 bp, Mus musculus
tttgcgaggaggtggttataaccct

SEQ ID NO: 973937 - DNA, 25 bp, Mus musculus
tttgcgagggtcactggagtcactc

SEQ ID NO: 973938 - DNA, 25 bp, Mus musculus
tttgcgagggtctctggagtcactc

SEQ ID NO: 973939 - DNA, 25 bp, Mus musculus
tttgcgaggtgtcgaaagactactt

SEQ ID NO: 973940 - DNA, 25 bp, Mus musculus
tttgcgaggtgtggaaagactactt

SEQ ID NO: 973941 - DNA, 25 bp, Mus musculus
tttgcgatcccaattctgtcccaat

SEQ ID NO: 973942 - DNA, 25 bp, Mus musculus
tttgcgatcccatttctgtcccaat

SEQ ID NO: 973943 - DNA, 25 bp, Mus musculus
tttgcgatgcaaattatctgtgtgg

SEQ ID NO: 973944 - DNA, 25 bp, Mus musculus
tttgcgatgcaatttatctgtgtgg

SEQ ID NO: 973945 - DNA, 25 bp, Mus musculus
tttgcgccatcaccactcagaaagg

SEQ ID NO: 973946 - DNA, 25 bp, Mus musculus
tttgcgccatcagcactcagaaagg

SEQ ID NO: 973947 - DNA, 25 bp, Mus musculus
tttgcgccgagtacttgtgtaagta

SEQ ID NO: 973948 - DNA, 25 bp, Mus musculus
tttgcgccgagttcttgtgtaagta

SEQ ID NO: 973949 - DNA, 25 bp, Mus musculus
tttgcgccgcgcacgtctgcttgcg

SEQ ID NO: 973950 - DNA, 25 bp, Mus musculus
tttgcgccgcgctcgtctgcttgcg

SEQ ID NO: 973951 - DNA, 25 bp, Mus musculus
tttgcgctcattccgactaaggtca

SEQ ID NO: 973952 - DNA, 25 bp, Mus musculus
tttgcgctcattgcgactaaggtca

SEQ ID NO: 973953 - DNA, 25 bp, Mus musculus
tttgcgctccacatcaggttgctca

SEQ ID NO: 973954 - DNA, 25 bp, Mus musculus
tttgcgctccacttcaggttgctca

SEQ ID NO: 973955 - DNA, 25 bp, Mus musculus
tttgcgctgaagcatgaccacatcc

SEQ ID NO: 973956 - DNA, 25 bp, Mus musculus
tttgcgctgaaggatgaccacatcc

SEQ ID NO: 973957 - DNA, 25 bp, Mus musculus
tttgcgctgtccctttgagagtaaa

SEQ ID NO: 973958 - DNA, 25 bp, Mus musculus
tttgcgctgtccgtttgagagtaaa

SEQ ID NO: 973959 - DNA, 25 bp, Mus musculus
tttgcgcttgcccagggcatccagc

SEQ ID NO: 973960 - DNA, 25 bp, Mus musculus
tttgcgcttgccgagggcatccagc

SEQ ID NO: 973961 - DNA, 25 bp, Mus musculus
tttgcggagcttcacccggaccaac

SEQ ID NO: 973962 - DNA, 25 bp, Mus musculus
tttgcggagcttgacccggaccaac

SEQ ID NO: 973963 - DNA, 25 bp, Mus musculus
tttgcggcagatctctccttgaacc

SEQ ID NO: 973964 - DNA, 25 bp, Mus musculus
tttgcggcagatgtctccttgaacc

SEQ ID NO: 973965 - DNA, 25 bp, Mus musculus
tttgcggcgcagctggcatatgata

SEQ ID NO: 973966 - DNA, 25 bp, Mus musculus
tttgcggcgcaggtggcatatgata

SEQ ID NO: 973967 - DNA, 25 bp, Mus musculus
tttgcggctgttacagtttttcctt

SEQ ID NO: 973968 - DNA, 25 bp, Mus musculus
tttgcggctgtttcagtttttcctt

SEQ ID NO: 973969 - DNA, 25 bp, Mus musculus
tttgcgggaatgcttagtggctacc

SEQ ID NO: 973970 - DNA, 25 bp, Mus musculus
tttgcgggaatggttagtggctacc

SEQ ID NO: 973971 - DNA, 25 bp, Mus musculus
tttgcggtcacacaatgggccaggt

SEQ ID NO: 973972 - DNA, 25 bp, Mus musculus
tttgcggtcacagaatgggccaggt

SEQ ID NO: 973973 - DNA, 25 bp, Mus musculus
tttgcggttagaatggtcttgttgc

SEQ ID NO: 973974 - DNA, 25 bp, Mus musculus
tttgcggttagattggtcttgttgc

SEQ ID NO: 973975 - DNA, 25 bp, Mus musculus
tttgcggtttttctgggacaacaag

SEQ ID NO: 973976 - DNA, 25 bp, Mus musculus
tttgcggtttttgtgggacaacaag

SEQ ID NO: 973977 - DNA, 25 bp, Mus musculus
tttgcgtcaccaaagactgcctgtt

SEQ ID NO: 973978 - DNA, 25 bp, Mus musculus
tttgcgtcaccatagactgcctgtt

SEQ ID NO: 973979 - DNA, 25 bp, Mus musculus
tttgcgtcctctagattcgccagaa

SEQ ID NO: 973980 - DNA, 25 bp, Mus musculus
tttgcgtcctcttgattcgccagaa

SEQ ID NO: 973981 - DNA, 25 bp, Mus musculus
tttgcgtcttggcagaaaacagaaa

SEQ ID NO: 973982 - DNA, 25 bp, Mus musculus
tttgcgtcttgggagaaaacagaaa

SEQ ID NO: 973983 - DNA, 25 bp, Mus musculus
tttgcgtgatgtccacaggatccgt

SEQ ID NO: 973984 - DNA, 25 bp, Mus musculus
tttgcgtgatgtgcacaggatccgt

SEQ ID NO: 973985 - DNA, 25 bp, Mus musculus
tttgcgtgtattatctgcagggctg

SEQ ID NO: 973986 - DNA, 25 bp, Mus musculus
tttgcgtgtattttctgcagggctg

SEQ ID NO: 973987 - DNA, 25 bp, Mus musculus
tttgcgttaacgcacatctatgtga

SEQ ID NO: 973988 - DNA, 25 bp, Mus musculus
tttgcgttaacggacatctatgtga

SEQ ID NO: 973989 - DNA, 25 bp, Mus musculus
tttgcgttatgccaccattatgagc

SEQ ID NO: 973990 - DNA, 25 bp, Mus musculus
tttgcgttatgcgaccattatgagc

SEQ ID NO: 973991 - DNA, 25 bp, Mus musculus
tttgcgttcataccacggtgcctga

SEQ ID NO: 973992 - DNA, 25 bp, Mus musculus
tttgcgttcatagcacggtgcctga

SEQ ID NO: 973993 - DNA, 25 bp, Mus musculus
tttgcgttccgtcttacagacttgg

SEQ ID NO: 973994 - DNA, 25 bp, Mus musculus
tttgcgttccgtgttacagacttgg

SEQ ID NO: 973995 - DNA, 25 bp, Mus musculus
tttgctaaaggcagctccccgaggg

SEQ ID NO: 973996 - DNA, 25 bp, Mus musculus
tttgctaaaggctgctccccgaggg

SEQ ID NO: 973997 - DNA, 25 bp, Mus musculus
tttgctaacttcagtgcttatccct

SEQ ID NO: 973998 - DNA, 25 bp, Mus musculus
tttgctaacttctgtgcttatccct

SEQ ID NO: 973999 - DNA, 25 bp, Mus musculus
tttgctaagtgcaacctaggccaga

SEQ ID NO: 974000 - DNA, 25 bp, Mus musculus
tttgctaagtgctacctaggccaga

SEQ ID NO: 974001 - DNA, 25 bp, Mus musculus
tttgctaatacccatttggagctat

SEQ ID NO: 974002 - DNA, 25 bp, Mus musculus
tttgctaataccgatttggagctat

SEQ ID NO: 974003 - DNA, 25 bp, Mus musculus
tttgctaatatcatggcagaatttt

SEQ ID NO: 974004 - DNA, 25 bp, Mus musculus
tttgctaatatcttggcagaatttt

SEQ ID NO: 974005 - DNA, 25 bp, Mus musculus
tttgctaatcaacgcatattctttt

SEQ ID NO: 974006 - DNA, 25 bp, Mus musculus
tttgctaatcaaggcatattctttt

SEQ ID NO: 974007 - DNA, 25 bp, Mus musculus
tttgctaatgctcgtctttctgcca

SEQ ID NO: 974008 - DNA, 25 bp, Mus musculus
tttgctaatgctggtctttctgcca

SEQ ID NO: 974009 - DNA, 25 bp, Mus musculus
tttgctaatggacgtgtggccacca

SEQ ID NO: 974010 - DNA, 25 bp, Mus musculus
tttgctaatggaggtgtggccacca

SEQ ID NO: 974011 - DNA, 25 bp, Mus musculus
tttgctaatggccttgtatgtaaca

SEQ ID NO: 974012 - DNA, 25 bp, Mus musculus
tttgctaatggcgttgtatgtaaca

SEQ ID NO: 974013 - DNA, 25 bp, Mus musculus
tttgctaattctcacttccagggcc

SEQ ID NO: 974014 - DNA, 25 bp, Mus musculus
tttgctaattctgacttccagggcc

SEQ ID NO: 974015 - DNA, 25 bp, Mus musculus
tttgctacaaacacatagccctgtg

SEQ ID NO: 974016 - DNA, 25 bp, Mus musculus
tttgctacaaactcatagccctgtg

SEQ ID NO: 974017 - DNA, 25 bp, Mus musculus
tttgctacacatagaaggccactgc

SEQ ID NO: 974018 - DNA, 25 bp, Mus musculus
tttgctacacattgaaggccactgc

SEQ ID NO: 974019 - DNA, 25 bp, Mus musculus
tttgctacataccacgagaggcgga

SEQ ID NO: 974020 - DNA, 25 bp, Mus musculus
tttgctacatacgacgagaggcgga

SEQ ID NO: 974021 - DNA, 25 bp, Mus musculus
tttgctacatcacttctgggataca

SEQ ID NO: 974022 - DNA, 25 bp, Mus musculus
tttgctacatcagttctgggataca

SEQ ID NO: 974023 - DNA, 25 bp, Mus musculus
tttgctacatcgaaacctcttggtt

SEQ ID NO: 974024 - DNA, 25 bp, Mus musculus
tttgctacatcgtaacctcttggtt

SEQ ID NO: 974025 - DNA, 25 bp, Mus musculus
tttgctacgggtcttcctgattgac

SEQ ID NO: 974026 - DNA, 25 bp, Mus musculus
tttgctacgggtgttcctgattgac

SEQ ID NO: 974027 - DNA, 25 bp, Mus musculus
tttgctactaagaccagtgctgccg

SEQ ID NO: 974028 - DNA, 25 bp, Mus musculus
tttgctactaagtccagtgctgccg

SEQ ID NO: 974029 - DNA, 25 bp, Mus musculus
tttgctactgcaatatcgttgtata

SEQ ID NO: 974030 - DNA, 25 bp, Mus musculus
tttgctactgcattatcgttgtata

SEQ ID NO: 974031 - DNA, 25 bp, Mus musculus
tttgctactgcccactagagtgttg

SEQ ID NO: 974032 - DNA, 25 bp, Mus musculus
tttgctactgccgactagagtgttg

SEQ ID NO: 974033 - DNA, 25 bp, Mus musculus
tttgctactgtcatcaacttggtgc

SEQ ID NO: 974034 - DNA, 25 bp, Mus musculus
tttgctactgtcttcaacttggtgc

SEQ ID NO: 974035 - DNA, 25 bp, Mus musculus
tttgctactgtgctatccatagaga

SEQ ID NO: 974036 - DNA, 25 bp, Mus musculus
tttgctactgtggtatccatagaga

SEQ ID NO: 974037 - DNA, 25 bp, Mus musculus
tttgctactgttatgtgccataatg

SEQ ID NO: 974038 - DNA, 25 bp, Mus musculus
tttgctactgttttgtgccataatg

SEQ ID NO: 974039 - DNA, 25 bp, Mus musculus
tttgctacttcaactcaccggaata

SEQ ID NO: 974040 - DNA, 25 bp, Mus musculus
tttgctacttcatctcaccggaata

SEQ ID NO: 974041 - DNA, 25 bp, Mus musculus
tttgctacttgaagcctgctctttc

SEQ ID NO: 974042 - DNA, 25 bp, Mus musculus
tttgctacttgatgcctgctctttc

SEQ ID NO: 974043 - DNA, 25 bp, Mus musculus
tttgctaggcataaccacggctgtg

SEQ ID NO: 974044 - DNA, 25 bp, Mus musculus
tttgctaggcattaccacggctgtg

SEQ ID NO: 974045 - DNA, 25 bp, Mus musculus
tttgctaggctcagtcgacacagaa

SEQ ID NO: 974046 - DNA, 25 bp, Mus musculus
tttgctaggctctgtcgacacagaa

SEQ ID NO: 974047 - DNA, 25 bp, Mus musculus
tttgctaggttcatgctgatctcca

SEQ ID NO: 974048 - DNA, 25 bp, Mus musculus
tttgctaggttcttgctgatctcca

SEQ ID NO: 974049 - DNA, 25 bp, Mus musculus
tttgctagtccgcacactgcgtatt

SEQ ID NO: 974050 - DNA, 25 bp, Mus musculus
tttgctagtccggacactgcgtatt

SEQ ID NO: 974051 - DNA, 25 bp, Mus musculus
tttgctagttccaatcttctgagat

SEQ ID NO: 974052 - DNA, 25 bp, Mus musculus
tttgctagttcctatcttctgagat

SEQ ID NO: 974053 - DNA, 25 bp, Mus musculus
tttgctatccaacaccattgggtat

SEQ ID NO: 974054 - DNA, 25 bp, Mus musculus
tttgctatccaagaccattgggtat

SEQ ID NO: 974055 - DNA, 25 bp, Mus musculus
tttgctatcggcctcaactttctta

SEQ ID NO: 974056 - DNA, 25 bp, Mus musculus
tttgctatcggcgtcaactttctta

SEQ ID NO: 974057 - DNA, 25 bp, Mus musculus
tttgctatgaacactgtgactcact

SEQ ID NO: 974058 - DNA, 25 bp, Mus musculus
tttgctatgaactctgtgactcact

SEQ ID NO: 974059 - DNA, 25 bp, Mus musculus
tttgctatgcgcagtactgtgtagc

SEQ ID NO: 974060 - DNA, 25 bp, Mus musculus
tttgctatgcgctgtactgtgtagc

SEQ ID NO: 974061 - DNA, 25 bp, Mus musculus
tttgctatggcacttctgggctgtg

SEQ ID NO: 974062 - DNA, 25 bp, Mus musculus
tttgctatggcagttctgggctgtg

SEQ ID NO: 974063 - DNA, 25 bp, Mus musculus
tttgctatggttaggtgacacttaa

SEQ ID NO: 974064 - DNA, 25 bp, Mus musculus
tttgctatggtttggtgacacttaa

SEQ ID NO: 974065 - DNA, 25 bp, Mus musculus
tttgctattgacatcacagtgacca

SEQ ID NO: 974066 - DNA, 25 bp, Mus musculus
tttgctattgacttcacagtgacca

SEQ ID NO: 974067 - DNA, 25 bp, Mus musculus
tttgctatttccacgtggcttagaa

SEQ ID NO: 974068 - DNA, 25 bp, Mus musculus
tttgctatttcctcgtggcttagaa

SEQ ID NO: 974069 - DNA, 25 bp, Mus musculus
tttgctatttctccaagggcgtcta

SEQ ID NO: 974070 - DNA, 25 bp, Mus musculus
tttgctatttctgcaagggcgtcta

SEQ ID NO: 974071 - DNA, 25 bp, Mus musculus
tttgctatttgtacgcccaaactag

SEQ ID NO: 974072 - DNA, 25 bp, Mus musculus
tttgctatttgttcgcccaaactag

SEQ ID NO: 974073 - DNA, 25 bp, Mus musculus
tttgctattttcacccaaacctgta

SEQ ID NO: 974074 - DNA, 25 bp, Mus musculus
tttgctattttctcccaaacctgta

SEQ ID NO: 974075 - DNA, 25 bp, Mus musculus
tttgctcaacataaacctcacactg

SEQ ID NO: 974076 - DNA, 25 bp, Mus musculus
tttgctcaacattaacctcacactg

SEQ ID NO: 974077 - DNA, 25 bp, Mus musculus
tttgctcaagacaatcaacccttct

SEQ ID NO: 974078 - DNA, 25 bp, Mus musculus
tttgctcaagacacgggttggccat

SEQ ID NO: 974079 - DNA, 25 bp, Mus musculus
tttgctcaagactatcaacccttct

SEQ ID NO: 974080 - DNA, 25 bp, Mus musculus
tttgctcaagactcgggttggccat

SEQ ID NO: 974081 - DNA, 25 bp, Mus musculus
tttgctcaagtactttgtttacagt

SEQ ID NO: 974082 - DNA, 25 bp, Mus musculus
tttgctcaagtagtttgtttacagt

SEQ ID NO: 974083 - DNA, 25 bp, Mus musculus
tttgctcacattaacgatcctgaag

SEQ ID NO: 974084 - DNA, 25 bp, Mus musculus
tttgctcacatttacgatcctgaag

SEQ ID NO: 974085 - DNA, 25 bp, Mus musculus
tttgctcaccacattgcaggctcag

SEQ ID NO: 974086 - DNA, 25 bp, Mus musculus
tttgctcaccactttgcaggctcag

SEQ ID NO: 974087 - DNA, 25 bp, Mus musculus
tttgctcacgctagctaggcacgca

SEQ ID NO: 974088 - DNA, 25 bp, Mus musculus
tttgctcacgcttgctaggcacgca

SEQ ID NO: 974089 - DNA, 25 bp, Mus musculus
tttgctcacttcacttcagacagga

SEQ ID NO: 974090 - DNA, 25 bp, Mus musculus
tttgctcacttcctggcaagggcag

SEQ ID NO: 974091 - DNA, 25 bp, Mus musculus
tttgctcacttcgtggcaagggcag

SEQ ID NO: 974092 - DNA, 25 bp, Mus musculus
tttgctcacttctcttcagacagga

SEQ ID NO: 974093 - DNA, 25 bp, Mus musculus
tttgctcagatgaccatgccttgcc

SEQ ID NO: 974094 - DNA, 25 bp, Mus musculus
tttgctcagatgtccatgccttgcc

SEQ ID NO: 974095 - DNA, 25 bp, Mus musculus
tttgctcagccccacataataacat

SEQ ID NO: 974096 - DNA, 25 bp, Mus musculus
tttgctcagcccgacataataacat

SEQ ID NO: 974097 - DNA, 25 bp, Mus musculus
tttgctcaggtgcatgtggactcat

SEQ ID NO: 974098 - DNA, 25 bp, Mus musculus
tttgctcaggtggatgtggactcat

SEQ ID NO: 974099 - DNA, 25 bp, Mus musculus
tttgctcagtagctggcccgcctgt

SEQ ID NO: 974100 - DNA, 25 bp, Mus musculus
tttgctcagtaggtggcccgcctgt

SEQ ID NO: 974101 - DNA, 25 bp, Mus musculus
tttgctcatagcagtcttcttgatt

SEQ ID NO: 974102 - DNA, 25 bp, Mus musculus
tttgctcatagctgtcttcttgatt

SEQ ID NO: 974103 - DNA, 25 bp, Mus musculus
tttgctcatgttattccgaagtctg

SEQ ID NO: 974104 - DNA, 25 bp, Mus musculus
tttgctcatgtttttccgaagtctg

SEQ ID NO: 974105 - DNA, 25 bp, Mus musculus
tttgctcattcacgagaggacccac

SEQ ID NO: 974106 - DNA, 25 bp, Mus musculus
tttgctcattcaggagaggacccac

SEQ ID NO: 974107 - DNA, 25 bp, Mus musculus
tttgctccagaacggctcgagttac

SEQ ID NO: 974108 - DNA, 25 bp, Mus musculus
tttgctccagaagggctcgagttac

SEQ ID NO: 974109 - DNA, 25 bp, Mus musculus
tttgctccagctactagtctgacaa

SEQ ID NO: 974110 - DNA, 25 bp, Mus musculus
tttgctccagcttctagtctgacaa

SEQ ID NO: 974111 - DNA, 25 bp, Mus musculus
tttgctccatcaatccaaccagttc

SEQ ID NO: 974112 - DNA, 25 bp, Mus musculus
tttgctccatcattccaaccagttc

SEQ ID NO: 974113 - DNA, 25 bp, Mus musculus
tttgctccattactctaattgctcc

SEQ ID NO: 974114 - DNA, 25 bp, Mus musculus
tttgctccattagtctaattgctcc

SEQ ID NO: 974115 - DNA, 25 bp, Mus musculus
tttgctccatttcccttcagaaggg

SEQ ID NO: 974116 - DNA, 25 bp, Mus musculus
tttgctccatttgccttcagaaggg

SEQ ID NO: 974117 - DNA, 25 bp, Mus musculus
tttgctcccattccagctgccttat

SEQ ID NO: 974118 - DNA, 25 bp, Mus musculus
tttgctcccattgcagctgccttat

SEQ ID NO: 974119 - DNA, 25 bp, Mus musculus
tttgctccccatagaagcaggcaag

SEQ ID NO: 974120 - DNA, 25 bp, Mus musculus
tttgctccccattgaagcaggcaag

SEQ ID NO: 974121 - DNA, 25 bp, Mus musculus
tttgctcccctaatatgaatataat

SEQ ID NO: 974122 - DNA, 25 bp, Mus musculus
tttgctcccctattatgaatataat

SEQ ID NO: 974123 - DNA, 25 bp, Mus musculus
tttgctcccgcactggtaaatttaa

SEQ ID NO: 974124 - DNA, 25 bp, Mus musculus
tttgctcccgcagtggtaaatttaa

SEQ ID NO: 974125 - DNA, 25 bp, Mus musculus
tttgctcccttcagacttcatacca

SEQ ID NO: 974126 - DNA, 25 bp, Mus musculus
tttgctcccttctgacttcatacca

SEQ ID NO: 974127 - DNA, 25 bp, Mus musculus
tttgctccgaggcagcaacagtgtg

SEQ ID NO: 974128 - DNA, 25 bp, Mus musculus
tttgctccgagggagcaacagtgtg

SEQ ID NO: 974129 - DNA, 25 bp, Mus musculus
tttgctccgcctcttggtctattta

SEQ ID NO: 974130 - DNA, 25 bp, Mus musculus
tttgctccgcctgttggtctattta

SEQ ID NO: 974131 - DNA, 25 bp, Mus musculus
tttgctccggtactggttatgtctt

SEQ ID NO: 974132 - DNA, 25 bp, Mus musculus
tttgctccggtagtggttatgtctt

SEQ ID NO: 974133 - DNA, 25 bp, Mus musculus
tttgctcctagcattcagcagcttg

SEQ ID NO: 974134 - DNA, 25 bp, Mus musculus
tttgctcctagctttcagcagcttg

SEQ ID NO: 974135 - DNA, 25 bp, Mus musculus
tttgctcctcagagtagtacctaac

SEQ ID NO: 974136 - DNA, 25 bp, Mus musculus
tttgctcctcagtgtagtacctaac

SEQ ID NO: 974137 - DNA, 25 bp, Mus musculus
tttgctcctgttcacgtgttcatat

SEQ ID NO: 974138 - DNA, 25 bp, Mus musculus
tttgctcctgttgacgtgttcatat

SEQ ID NO: 974139 - DNA, 25 bp, Mus musculus
tttgctccttctcggctgttagttc

SEQ ID NO: 974140 - DNA, 25 bp, Mus musculus
tttgctccttctgggctgttagttc

SEQ ID NO: 974141 - DNA, 25 bp, Mus musculus
tttgctcgagcaaagctatggctta

SEQ ID NO: 974142 - DNA, 25 bp, Mus musculus
tttgctcgagcatagctatggctta

SEQ ID NO: 974143 - DNA, 25 bp, Mus musculus
tttgctcgcatcaccagaccaggat

SEQ ID NO: 974144 - DNA, 25 bp, Mus musculus
tttgctcgcatctccagaccaggat

SEQ ID NO: 974145 - DNA, 25 bp, Mus musculus
tttgctcgctggacaaaactacagt

SEQ ID NO: 974146 - DNA, 25 bp, Mus musculus
tttgctcgctggtcaaaactacagt

SEQ ID NO: 974147 - DNA, 25 bp, Mus musculus
tttgctcggcgacgaatccacgaca

SEQ ID NO: 974148 - DNA, 25 bp, Mus musculus
tttgctcggcgaggaatccacgaca

SEQ ID NO: 974149 - DNA, 25 bp, Mus musculus
tttgctctataccatgctagctttg

SEQ ID NO: 974150 - DNA, 25 bp, Mus musculus
tttgctctatacgatgctagctttg

SEQ ID NO: 974151 - DNA, 25 bp, Mus musculus
tttgctctattgagacaggctccag

SEQ ID NO: 974152 - DNA, 25 bp, Mus musculus
tttgctctattgtgacaggctccag

SEQ ID NO: 974153 - DNA, 25 bp, Mus musculus
tttgctctcactaaaacctatccat

SEQ ID NO: 974154 - DNA, 25 bp, Mus musculus
tttgctctcacttaaacctatccat

SEQ ID NO: 974155 - DNA, 25 bp, Mus musculus
tttgctctcatcagcatcaaacttg

SEQ ID NO: 974156 - DNA, 25 bp, Mus musculus
tttgctctcatctgcatcaaacttg

SEQ ID NO: 974157 - DNA, 25 bp, Mus musculus
tttgctctcatgattcagggtcttc

SEQ ID NO: 974158 - DNA, 25 bp, Mus musculus
tttgctctcatgtttcagggtcttc

SEQ ID NO: 974159 - DNA, 25 bp, Mus musculus
tttgctctcctcaaagggcttatga

SEQ ID NO: 974160 - DNA, 25 bp, Mus musculus
tttgctctcctccagcacaaaggat

SEQ ID NO: 974161 - DNA, 25 bp, Mus musculus
tttgctctcctcgagcacaaaggat

SEQ ID NO: 974162 - DNA, 25 bp, Mus musculus
tttgctctcctctaagggcttatga

SEQ ID NO: 974163 - DNA, 25 bp, Mus musculus
tttgctctctctcagaccagaggca

SEQ ID NO: 974164 - DNA, 25 bp, Mus musculus
tttgctctctctcagtttgacaggt

SEQ ID NO: 974165 - DNA, 25 bp, Mus musculus
tttgctctctctgagaccagaggca

SEQ ID NO: 974166 - DNA, 25 bp, Mus musculus
tttgctctctctgagtttgacaggt

SEQ ID NO: 974167 - DNA, 25 bp, Mus musculus
tttgctctctgtcttaactgtcctg

SEQ ID NO: 974168 - DNA, 25 bp, Mus musculus
tttgctctctgtgttaactgtcctg

SEQ ID NO: 974169 - DNA, 25 bp, Mus musculus
tttgctctcttgatgctctacttct

SEQ ID NO: 974170 - DNA, 25 bp, Mus musculus
tttgctctcttgttgctctacttct

SEQ ID NO: 974171 - DNA, 25 bp, Mus musculus
tttgctctctttagtccacattgta

SEQ ID NO: 974172 - DNA, 25 bp, Mus musculus
tttgctctcttttgtccacattgta

SEQ ID NO: 974173 - DNA, 25 bp, Mus musculus
tttgctctgaacctaaaactctttt

SEQ ID NO: 974174 - DNA, 25 bp, Mus musculus
tttgctctgaacgtaaaactctttt

SEQ ID NO: 974175 - DNA, 25 bp, Mus musculus
tttgctctgaggaacctgaactttt

SEQ ID NO: 974176 - DNA, 25 bp, Mus musculus
tttgctctgaggtacctgaactttt

SEQ ID NO: 974177 - DNA, 25 bp, Mus musculus
tttgctctgccgaaggtgtcttata

SEQ ID NO: 974178 - DNA, 25 bp, Mus musculus
tttgctctgccgtaggtgtcttata

SEQ ID NO: 974179 - DNA, 25 bp, Mus musculus
tttgctctggatcaaacctcactgg

SEQ ID NO: 974180 - DNA, 25 bp, Mus musculus
tttgctctggatgaaacctcactgg

SEQ ID NO: 974181 - DNA, 25 bp, Mus musculus
tttgctctggctactagtgtcatgc

SEQ ID NO: 974182 - DNA, 25 bp, Mus musculus
tttgctctggcttctagtgtcatgc

SEQ ID NO: 974183 - DNA, 25 bp, Mus musculus
tttgctctgtccatcacagctgctg

SEQ ID NO: 974184 - DNA, 25 bp, Mus musculus
tttgctctgtccatctgataggagt

SEQ ID NO: 974185 - DNA, 25 bp, Mus musculus
tttgctctgtccttcacagctgctg

SEQ ID NO: 974186 - DNA, 25 bp, Mus musculus
tttgctctgtccttctgataggagt

SEQ ID NO: 974187 - DNA, 25 bp, Mus musculus
tttgctctgtctcagtggccctttt

SEQ ID NO: 974188 - DNA, 25 bp, Mus musculus
tttgctctgtctgagtggccctttt

SEQ ID NO: 974189 - DNA, 25 bp, Mus musculus
tttgctctgtgccttgaatctttta

SEQ ID NO: 974190 - DNA, 25 bp, Mus musculus
tttgctctgtgcgttgaatctttta

SEQ ID NO: 974191 - DNA, 25 bp, Mus musculus
tttgctcttaatccctttgctggac

SEQ ID NO: 974192 - DNA, 25 bp, Mus musculus
tttgctcttaatgcctttgctggac

SEQ ID NO: 974193 - DNA, 25 bp, Mus musculus
tttgctcttatacagcgagtacttt

SEQ ID NO: 974194 - DNA, 25 bp, Mus musculus
tttgctcttatagagcgagtacttt

SEQ ID NO: 974195 - DNA, 25 bp, Mus musculus
tttgctcttcagatacaatggccag

SEQ ID NO: 974196 - DNA, 25 bp, Mus musculus
tttgctcttcagttacaatggccag

SEQ ID NO: 974197 - DNA, 25 bp, Mus musculus
tttgctcttctaactgccttaatgg

SEQ ID NO: 974198 - DNA, 25 bp, Mus musculus
tttgctcttctatctgccttaatgg

SEQ ID NO: 974199 - DNA, 25 bp, Mus musculus
tttgctcttggcctatgaaaacgga

SEQ ID NO: 974200 - DNA, 25 bp, Mus musculus
tttgctcttggcgtatgaaaacgga

SEQ ID NO: 974201 - DNA, 25 bp, Mus musculus
tttgctcttggtaagccccaggatc

SEQ ID NO: 974202 - DNA, 25 bp, Mus musculus
tttgctcttggttagccccaggatc

SEQ ID NO: 974203 - DNA, 25 bp, Mus musculus
tttgctctttacatatatggaatga

SEQ ID NO: 974204 - DNA, 25 bp, Mus musculus
tttgctctttacctgctcagcgaaa

SEQ ID NO: 974205 - DNA, 25 bp, Mus musculus
tttgctctttacgtgctcagcgaaa

SEQ ID NO: 974206 - DNA, 25 bp, Mus musculus
tttgctctttacttatatggaatga

SEQ ID NO: 974207 - DNA, 25 bp, Mus musculus
tttgctgaactgattgaccctgtga

SEQ ID NO: 974208 - DNA, 25 bp, Mus musculus
tttgctgaactgtttgaccctgtga

SEQ ID NO: 974209 - DNA, 25 bp, Mus musculus
tttgctgaatataattaccgtaggc

SEQ ID NO: 974210 - DNA, 25 bp, Mus musculus
tttgctgaatattattaccgtaggc

SEQ ID NO: 974211 - DNA, 25 bp, Mus musculus
tttgctgacagtactattaaacttg

SEQ ID NO: 974212 - DNA, 25 bp, Mus musculus
tttgctgacagttctattaaacttg

SEQ ID NO: 974213 - DNA, 25 bp, Mus musculus
tttgctgacatgacctccaagagtg

SEQ ID NO: 974214 - DNA, 25 bp, Mus musculus
tttgctgacatgtcctccaagagtg

SEQ ID NO: 974215 - DNA, 25 bp, Mus musculus
tttgctgaccaacaaggcccattat

SEQ ID NO: 974216 - DNA, 25 bp, Mus musculus
tttgctgaccaagaaggcccattat

SEQ ID NO: 974217 - DNA, 25 bp, Mus musculus
tttgctgaccgcctacagtcgtgac

SEQ ID NO: 974218 - DNA, 25 bp, Mus musculus
tttgctgaccgcgtacagtcgtgac

SEQ ID NO: 974219 - DNA, 25 bp, Mus musculus
tttgctgacgtgcttctatttatgg

SEQ ID NO: 974220 - DNA, 25 bp, Mus musculus
tttgctgacgtggttctatttatgg

SEQ ID NO: 974221 - DNA, 25 bp, Mus musculus
tttgctgacttgaacctgctgctgc

SEQ ID NO: 974222 - DNA, 25 bp, Mus musculus
tttgctgacttgtacctgctgctgc

SEQ ID NO: 974223 - DNA, 25 bp, Mus musculus
tttgctgactttcagcacatcatcc

SEQ ID NO: 974224 - DNA, 25 bp, Mus musculus
tttgctgactttgagcacatcatcc

SEQ ID NO: 974225 - DNA, 25 bp, Mus musculus
tttgctgagcacatcttcatttgcg

SEQ ID NO: 974226 - DNA, 25 bp, Mus musculus
tttgctgagcacttcttcatttgcg

SEQ ID NO: 974227 - DNA, 25 bp, Mus musculus
tttgctgagctcacttacactctgg

SEQ ID NO: 974228 - DNA, 25 bp, Mus musculus
tttgctgagctctcttacactctgg

SEQ ID NO: 974229 - DNA, 25 bp, Mus musculus
tttgctgagtggcaggagcatccta

SEQ ID NO: 974230 - DNA, 25 bp, Mus musculus
tttgctgagtgggaggagcatccta

SEQ ID NO: 974231 - DNA, 25 bp, Mus musculus
tttgctgatctcaaacgggcactta

SEQ ID NO: 974232 - DNA, 25 bp, Mus musculus
tttgctgatctctaacgggcactta

SEQ ID NO: 974233 - DNA, 25 bp, Mus musculus
tttgctgatcttcgcttcctggctt

SEQ ID NO: 974234 - DNA, 25 bp, Mus musculus
tttgctgatcttggcttcctggctt

SEQ ID NO: 974235 - DNA, 25 bp, Mus musculus
tttgctgcaaagagaaaccgctttt

SEQ ID NO: 974236 - DNA, 25 bp, Mus musculus
tttgctgcaaagtgaaaccgctttt

SEQ ID NO: 974237 - DNA, 25 bp, Mus musculus
tttgctgcaggtaagtaacattgtt

SEQ ID NO: 974238 - DNA, 25 bp, Mus musculus
tttgctgcaggttagtaacattgtt

SEQ ID NO: 974239 - DNA, 25 bp, Mus musculus
tttgctgcatcacgttttcctctag

SEQ ID NO: 974240 - DNA, 25 bp, Mus musculus
tttgctgcatcaggttttcctctag

SEQ ID NO: 974241 - DNA, 25 bp, Mus musculus
tttgctgccaacagctcattcttga

SEQ ID NO: 974242 - DNA, 25 bp, Mus musculus
tttgctgccaactgctcattcttga

SEQ ID NO: 974243 - DNA, 25 bp, Mus musculus
tttgctgccaagcttcacagctgac

SEQ ID NO: 974244 - DNA, 25 bp, Mus musculus
tttgctgccaaggttcacagctgac

SEQ ID NO: 974245 - DNA, 25 bp, Mus musculus
tttgctgccagcacgtgagatcctg

SEQ ID NO: 974246 - DNA, 25 bp, Mus musculus
tttgctgccagctcgtgagatcctg

SEQ ID NO: 974247 - DNA, 25 bp, Mus musculus
tttgctgcccaactgtagacatcca

SEQ ID NO: 974248 - DNA, 25 bp, Mus musculus
tttgctgcccaagtgtagacatcca

SEQ ID NO: 974249 - DNA, 25 bp, Mus musculus
tttgctgccgtgctggactgaatcc

SEQ ID NO: 974250 - DNA, 25 bp, Mus musculus
tttgctgccgtggtggactgaatcc

SEQ ID NO: 974251 - DNA, 25 bp, Mus musculus
tttgctgccttccaactgtgctagc

SEQ ID NO: 974252 - DNA, 25 bp, Mus musculus
tttgctgccttccaagagcccaagc

SEQ ID NO: 974253 - DNA, 25 bp, Mus musculus
tttgctgccttcgaactgtgctagc

SEQ ID NO: 974254 - DNA, 25 bp, Mus musculus
tttgctgccttcgaagagcccaagc

SEQ ID NO: 974255 - DNA, 25 bp, Mus musculus
tttgctgcgcccaggaagattagat

SEQ ID NO: 974256 - DNA, 25 bp, Mus musculus
tttgctgcgccctggaagattagat

SEQ ID NO: 974257 - DNA, 25 bp, Mus musculus
tttgctgcgcttagaattctctcca

SEQ ID NO: 974258 - DNA, 25 bp, Mus musculus
tttgctgcgctttgaattctctcca

SEQ ID NO: 974259 - DNA, 25 bp, Mus musculus
tttgctgctaacacgaccaggaaat

SEQ ID NO: 974260 - DNA, 25 bp, Mus musculus
tttgctgctaactcgaccaggaaat

SEQ ID NO: 974261 - DNA, 25 bp, Mus musculus
tttgctgctacaagaatattcttta

SEQ ID NO: 974262 - DNA, 25 bp, Mus musculus
tttgctgctacatgaatattcttta

SEQ ID NO: 974263 - DNA, 25 bp, Mus musculus
tttgctgctcaacttatagacctgg

SEQ ID NO: 974264 - DNA, 25 bp, Mus musculus
tttgctgctcaagttatagacctgg

SEQ ID NO: 974265 - DNA, 25 bp, Mus musculus
tttgctgctcagctttttaaaggaa

SEQ ID NO: 974266 - DNA, 25 bp, Mus musculus
tttgctgctcaggtttttaaaggaa

SEQ ID NO: 974267 - DNA, 25 bp, Mus musculus
tttgctgctccccacagggacagga

SEQ ID NO: 974268 - DNA, 25 bp, Mus musculus
tttgctgctcccgacagggacagga

SEQ ID NO: 974269 - DNA, 25 bp, Mus musculus
tttgctgctctgaacaagcttgaga

SEQ ID NO: 974270 - DNA, 25 bp, Mus musculus
tttgctgctctgtacaagcttgaga

SEQ ID NO: 974271 - DNA, 25 bp, Mus musculus
tttgctgctgagaaagcgtccctgg

SEQ ID NO: 974272 - DNA, 25 bp, Mus musculus
tttgctgctgagaattttactataa

SEQ ID NO: 974273 - DNA, 25 bp, Mus musculus
tttgctgctgagtaagcgtccctgg

SEQ ID NO: 974274 - DNA, 25 bp, Mus musculus
tttgctgctgagtattttactataa

SEQ ID NO: 974275 - DNA, 25 bp, Mus musculus
tttgctgctgtcacatagagtccca

SEQ ID NO: 974276 - DNA, 25 bp, Mus musculus
tttgctgctgtctcatagagtccca

SEQ ID NO: 974277 - DNA, 25 bp, Mus musculus
tttgctgcttccacatgttacagtt

SEQ ID NO: 974278 - DNA, 25 bp, Mus musculus
tttgctgcttcctcatgttacagtt

SEQ ID NO: 974279 - DNA, 25 bp, Mus musculus
tttgctgcttggcaagagctgctag

SEQ ID NO: 974280 - DNA, 25 bp, Mus musculus
tttgctgcttgggaagagctgctag

SEQ ID NO: 974281 - DNA, 25 bp, Mus musculus
tttgctgcttgtagcatgcacacag

SEQ ID NO: 974282 - DNA, 25 bp, Mus musculus
tttgctgcttgttgcatgcacacag

SEQ ID NO: 974283 - DNA, 25 bp, Mus musculus
tttgctgctttcatgtataagcaac

SEQ ID NO: 974284 - DNA, 25 bp, Mus musculus
tttgctgctttcttgtataagcaac

SEQ ID NO: 974285 - DNA, 25 bp, Mus musculus
tttgctggaaacacctgcctgatgt

SEQ ID NO: 974286 - DNA, 25 bp, Mus musculus
tttgctggaaactcctgcctgatgt

SEQ ID NO: 974287 - DNA, 25 bp, Mus musculus
tttgctggaactccctgttcagttg

SEQ ID NO: 974288 - DNA, 25 bp, Mus musculus
tttgctggaactgcctgttcagttg

SEQ ID NO: 974289 - DNA, 25 bp, Mus musculus
tttgctggactcactaagttaacat

SEQ ID NO: 974290 - DNA, 25 bp, Mus musculus
tttgctggactctctaagttaacat

SEQ ID NO: 974291 - DNA, 25 bp, Mus musculus
tttgctggagctacacccaaagtga

SEQ ID NO: 974292 - DNA, 25 bp, Mus musculus
tttgctggagcttcacccaaagtga

SEQ ID NO: 974293 - DNA, 25 bp, Mus musculus
tttgctggatttcggtccaaaagac

SEQ ID NO: 974294 - DNA, 25 bp, Mus musculus
tttgctggatttgggtccaaaagac

SEQ ID NO: 974295 - DNA, 25 bp, Mus musculus
tttgctggcagcaacacactttaca

SEQ ID NO: 974296 - DNA, 25 bp, Mus musculus
tttgctggcagctacacactttaca

SEQ ID NO: 974297 - DNA, 25 bp, Mus musculus
tttgctggcctcaaagcaccctgat

SEQ ID NO: 974298 - DNA, 25 bp, Mus musculus
tttgctggcctctaagcaccctgat

SEQ ID NO: 974299 - DNA, 25 bp, Mus musculus
tttgctggctgaactgaatgtccct

SEQ ID NO: 974300 - DNA, 25 bp, Mus musculus
tttgctggctgatctgaatgtccct

SEQ ID NO: 974301 - DNA, 25 bp, Mus musculus
tttgctgggaaaaacttgactttgc

SEQ ID NO: 974302 - DNA, 25 bp, Mus musculus
tttgctgggaaacgcgactcctcta

SEQ ID NO: 974303 - DNA, 25 bp, Mus musculus
tttgctgggaaaggcgactcctcta

SEQ ID NO: 974304 - DNA, 25 bp, Mus musculus
tttgctgggaaatacttgactttgc

SEQ ID NO: 974305 - DNA, 25 bp, Mus musculus
tttgctgggataaatatgccataca

SEQ ID NO: 974306 - DNA, 25 bp, Mus musculus
tttgctgggatatatatgccataca

SEQ ID NO: 974307 - DNA, 25 bp, Mus musculus
tttgctgggcaaatgcgtatttttt

SEQ ID NO: 974308 - DNA, 25 bp, Mus musculus
tttgctgggcaattgcgtatttttt

SEQ ID NO: 974309 - DNA, 25 bp, Mus musculus
tttgctgggctcatcgttgtttaaa

SEQ ID NO: 974310 - DNA, 25 bp, Mus musculus
tttgctgggctcttcgttgtttaaa

SEQ ID NO: 974311 - DNA, 25 bp, Mus musculus
tttgctgggtacacatatgttatgg

SEQ ID NO: 974312 - DNA, 25 bp, Mus musculus
tttgctgggtactcatatgttatgg

SEQ ID NO: 974313 - DNA, 25 bp, Mus musculus
tttgctggtcacaagactgtgttga

SEQ ID NO: 974314 - DNA, 25 bp, Mus musculus
tttgctggtcactagactgtgttga

SEQ ID NO: 974315 - DNA, 25 bp, Mus musculus
tttgctggtcttatgtagttcccat

SEQ ID NO: 974316 - DNA, 25 bp, Mus musculus
tttgctggtcttttgtagttcccat

SEQ ID NO: 974317 - DNA, 25 bp, Mus musculus
tttgctgtaaccctgcttccaccat

SEQ ID NO: 974318 - DNA, 25 bp, Mus musculus
tttgctgtaaccgtgcttccaccat

SEQ ID NO: 974319 - DNA, 25 bp, Mus musculus
tttgctgtaagtccacacgtgcctt

SEQ ID NO: 974320 - DNA, 25 bp, Mus musculus
tttgctgtaagtgcacacgtgcctt

SEQ ID NO: 974321 - DNA, 25 bp, Mus musculus
tttgctgtactcaatatgacatgct

SEQ ID NO: 974322 - DNA, 25 bp, Mus musculus
tttgctgtactcatcctagggaaaa

SEQ ID NO: 974323 - DNA, 25 bp, Mus musculus
tttgctgtactctatatgacatgct

SEQ ID NO: 974324 - DNA, 25 bp, Mus musculus
tttgctgtactcttcctagggaaaa

SEQ ID NO: 974325 - DNA, 25 bp, Mus musculus
tttgctgtagacaccaacgaggttc

SEQ ID NO: 974326 - DNA, 25 bp, Mus musculus
tttgctgtagactccaacgaggttc

SEQ ID NO: 974327 - DNA, 25 bp, Mus musculus
tttgctgtaggccttacccgagaaa

SEQ ID NO: 974328 - DNA, 25 bp, Mus musculus
tttgctgtaggcgttacccgagaaa

SEQ ID NO: 974329 - DNA, 25 bp, Mus musculus
tttgctgtatttcattcctccgcct

SEQ ID NO: 974330 - DNA, 25 bp, Mus musculus
tttgctgtatttgattcctccgcct

SEQ ID NO: 974331 - DNA, 25 bp, Mus musculus
tttgctgtcactcgtcatatggcca

SEQ ID NO: 974332 - DNA, 25 bp, Mus musculus
tttgctgtcactggtcatatggcca

SEQ ID NO: 974333 - DNA, 25 bp, Mus musculus
tttgctgtccgtagtagtgttttca

SEQ ID NO: 974334 - DNA, 25 bp, Mus musculus
tttgctgtccgttgtagtgttttca

SEQ ID NO: 974335 - DNA, 25 bp, Mus musculus
tttgctgtccttaatgtcttccttg

SEQ ID NO: 974336 - DNA, 25 bp, Mus musculus
tttgctgtcctttatgtcttccttg

SEQ ID NO: 974337 - DNA, 25 bp, Mus musculus
tttgctgtctaacctcaaggtgccc

SEQ ID NO: 974338 - DNA, 25 bp, Mus musculus
tttgctgtctaagctcaaggtgccc

SEQ ID NO: 974339 - DNA, 25 bp, Mus musculus
tttgctgtgcacacatgccttaata

SEQ ID NO: 974340 - DNA, 25 bp, Mus musculus
tttgctgtgcactcatgccttaata

SEQ ID NO: 974341 - DNA, 25 bp, Mus musculus
tttgctgtgctgaccatttgagatg

SEQ ID NO: 974342 - DNA, 25 bp, Mus musculus
tttgctgtgctgtccatttgagatg

SEQ ID NO: 974343 - DNA, 25 bp, Mus musculus
tttgctgtggctagtgctccgtgcc

SEQ ID NO: 974344 - DNA, 25 bp, Mus musculus
tttgctgtggcttgtgctccgtgcc

SEQ ID NO: 974345 - DNA, 25 bp, Mus musculus
tttgctgtgttcataagatatctat

SEQ ID NO: 974346 - DNA, 25 bp, Mus musculus
tttgctgtgttcttaagatatctat

SEQ ID NO: 974347 - DNA, 25 bp, Mus musculus
tttgctgttaacactaaagtccaac

SEQ ID NO: 974348 - DNA, 25 bp, Mus musculus
tttgctgttaactctaaagtccaac

SEQ ID NO: 974349 - DNA, 25 bp, Mus musculus
tttgctgttcccagatgcacagttc

SEQ ID NO: 974350 - DNA, 25 bp, Mus musculus
tttgctgttccctgatgcacagttc

SEQ ID NO: 974351 - DNA, 25 bp, Mus musculus
tttgctgttctgaagggccctggag

SEQ ID NO: 974352 - DNA, 25 bp, Mus musculus
tttgctgttctgtagggccctggag

SEQ ID NO: 974353 - DNA, 25 bp, Mus musculus
tttgctgttggcatctagtgctagt

SEQ ID NO: 974354 - DNA, 25 bp, Mus musculus
tttgctgttggcttctagtgctagt

SEQ ID NO: 974355 - DNA, 25 bp, Mus musculus
tttgctgtttctatggtaggtctta

SEQ ID NO: 974356 - DNA, 25 bp, Mus musculus
tttgctgtttctttggtaggtctta

SEQ ID NO: 974357 - DNA, 25 bp, Mus musculus
tttgctgtttttcctatgtcatctg

SEQ ID NO: 974358 - DNA, 25 bp, Mus musculus
tttgctgtttttgctatgtcatctg

SEQ ID NO: 974359 - DNA, 25 bp, Mus musculus
tttgcttaaaagagtggttgttaca

SEQ ID NO: 974360 - DNA, 25 bp, Mus musculus
tttgcttaaaagtgtggttgttaca

SEQ ID NO: 974361 - DNA, 25 bp, Mus musculus
tttgcttaaaatcgcaccagacctc

SEQ ID NO: 974362 - DNA, 25 bp, Mus musculus
tttgcttaaaatggcaccagacctc

SEQ ID NO: 974363 - DNA, 25 bp, Mus musculus
tttgcttaaacaatcccacctgcag

SEQ ID NO: 974364 - DNA, 25 bp, Mus musculus
tttgcttaaacattcccacctgcag

SEQ ID NO: 974365 - DNA, 25 bp, Mus musculus
tttgcttaaccaacagacgggtgct

SEQ ID NO: 974366 - DNA, 25 bp, Mus musculus
tttgcttaaccatcagacgggtgct

SEQ ID NO: 974367 - DNA, 25 bp, Mus musculus
tttgcttaagagatgggctgccgat

SEQ ID NO: 974368 - DNA, 25 bp, Mus musculus
tttgcttaagagttgggctgccgat

SEQ ID NO: 974369 - DNA, 25 bp, Mus musculus
tttgcttaatgccagtcagccacat

SEQ ID NO: 974370 - DNA, 25 bp, Mus musculus
tttgcttaatgcgagtcagccacat

SEQ ID NO: 974371 - DNA, 25 bp, Mus musculus
tttgcttaatttcctacagcctgag

SEQ ID NO: 974372 - DNA, 25 bp, Mus musculus
tttgcttaatttgctacagcctgag

SEQ ID NO: 974373 - DNA, 25 bp, Mus musculus
tttgcttacaagcaacccgatgccc

SEQ ID NO: 974374 - DNA, 25 bp, Mus musculus
tttgcttacaaggaacccgatgccc

SEQ ID NO: 974375 - DNA, 25 bp, Mus musculus
tttgcttacctaaaaaccctcgatt

SEQ ID NO: 974376 - DNA, 25 bp, Mus musculus
tttgcttacctataaaccctcgatt

SEQ ID NO: 974377 - DNA, 25 bp, Mus musculus
tttgcttactcaatgaccattctta

SEQ ID NO: 974378 - DNA, 25 bp, Mus musculus
tttgcttactcattgaccattctta

SEQ ID NO: 974379 - DNA, 25 bp, Mus musculus
tttgcttagcacattttactgtctt

SEQ ID NO: 974380 - DNA, 25 bp, Mus musculus
tttgcttagcactttttactgtctt

SEQ ID NO: 974381 - DNA, 25 bp, Mus musculus
tttgcttagggtaaactgtctttgt

SEQ ID NO: 974382 - DNA, 25 bp, Mus musculus
tttgcttagggttaactgtctttgt

SEQ ID NO: 974383 - DNA, 25 bp, Mus musculus
tttgcttatttaagcctatgttgga

SEQ ID NO: 974384 - DNA, 25 bp, Mus musculus
tttgcttatttatgcctatgttgga

SEQ ID NO: 974385 - DNA, 25 bp, Mus musculus
tttgcttcaaagctgttgacgccct

SEQ ID NO: 974386 - DNA, 25 bp, Mus musculus
tttgcttcaaaggtgttgacgccct

SEQ ID NO: 974387 - DNA, 25 bp, Mus musculus
tttgcttcagcaaatgggcagctca

SEQ ID NO: 974388 - DNA, 25 bp, Mus musculus
tttgcttcagcaacgacgatgtggg

SEQ ID NO: 974389 - DNA, 25 bp, Mus musculus
tttgcttcagcatatgggcagctca

SEQ ID NO: 974390 - DNA, 25 bp, Mus musculus
tttgcttcagcatcgacgatgtggg

SEQ ID NO: 974391 - DNA, 25 bp, Mus musculus
tttgcttcagctaggtgcttagccc

SEQ ID NO: 974392 - DNA, 25 bp, Mus musculus
tttgcttcagcttggtgcttagccc

SEQ ID NO: 974393 - DNA, 25 bp, Mus musculus
tttgcttcagggaatctttcttata

SEQ ID NO: 974394 - DNA, 25 bp, Mus musculus
tttgcttcagggtatctttcttata

SEQ ID NO: 974395 - DNA, 25 bp, Mus musculus
tttgcttcagtgatcactcccttta

SEQ ID NO: 974396 - DNA, 25 bp, Mus musculus
tttgcttcagtgttcactcccttta

SEQ ID NO: 974397 - DNA, 25 bp, Mus musculus
tttgcttcatttactctgtagcctc

SEQ ID NO: 974398 - DNA, 25 bp, Mus musculus
tttgcttcattttctctgtagcctc

SEQ ID NO: 974399 - DNA, 25 bp, Mus musculus
tttgcttccactatggtgagctgga

SEQ ID NO: 974400 - DNA, 25 bp, Mus musculus
tttgcttccactttggtgagctgga

SEQ ID NO: 974401 - DNA, 25 bp, Mus musculus
tttgcttcccaacccggatggagac

SEQ ID NO: 974402 - DNA, 25 bp, Mus musculus
tttgcttcccaagccggatggagac

SEQ ID NO: 974403 - DNA, 25 bp, Mus musculus
tttgcttcctaaaccaacactcttc

SEQ ID NO: 974404 - DNA, 25 bp, Mus musculus
tttgcttcctaatccaacactcttc

SEQ ID NO: 974405 - DNA, 25 bp, Mus musculus
tttgcttcctgtcttgttgtcatat

SEQ ID NO: 974406 - DNA, 25 bp, Mus musculus
tttgcttcctgtgttgttgtcatat

SEQ ID NO: 974407 - DNA, 25 bp, Mus musculus
tttgcttccttaattccttgcatag

SEQ ID NO: 974408 - DNA, 25 bp, Mus musculus
tttgcttccttatttccttgcatag

SEQ ID NO: 974409 - DNA, 25 bp, Mus musculus
tttgcttcgacactgtcctgtagca

SEQ ID NO: 974410 - DNA, 25 bp, Mus musculus
tttgcttcgacagtgtcctgtagca

SEQ ID NO: 974411 - DNA, 25 bp, Mus musculus
tttgcttctcagcaccaagaggatt

SEQ ID NO: 974412 - DNA, 25 bp, Mus musculus
tttgcttctcaggaccaagaggatt

SEQ ID NO: 974413 - DNA, 25 bp, Mus musculus
tttgcttctcgacatcatgggccag

SEQ ID NO: 974414 - DNA, 25 bp, Mus musculus
tttgcttctcgagatcatgggccag

SEQ ID NO: 974415 - DNA, 25 bp, Mus musculus
tttgcttctcttaggttcctttatt

SEQ ID NO: 974416 - DNA, 25 bp, Mus musculus
tttgcttctctttggttcctttatt

SEQ ID NO: 974417 - DNA, 25 bp, Mus musculus
tttgcttctgcgaccctcaagaacg

SEQ ID NO: 974418 - DNA, 25 bp, Mus musculus
tttgcttctgcgtccctcaagaacg

SEQ ID NO: 974419 - DNA, 25 bp, Mus musculus
tttgcttctggcaatacactgctag

SEQ ID NO: 974420 - DNA, 25 bp, Mus musculus
tttgcttctggctatacactgctag

SEQ ID NO: 974421 - DNA, 25 bp, Mus musculus
tttgcttctgtaaaggtctctttcc

SEQ ID NO: 974422 - DNA, 25 bp, Mus musculus
tttgcttctgtataggtctctttcc

SEQ ID NO: 974423 - DNA, 25 bp, Mus musculus
tttgcttcttgtctgtatgattctg

SEQ ID NO: 974424 - DNA, 25 bp, Mus musculus
tttgcttcttgtgtgtatgattctg

SEQ ID NO: 974425 - DNA, 25 bp, Mus musculus
tttgcttgccttaagggccacagca

SEQ ID NO: 974426 - DNA, 25 bp, Mus musculus
tttgcttgcctttagggccacagca

SEQ ID NO: 974427 - DNA, 25 bp, Mus musculus
tttgcttgcgataaggaactcttaa

SEQ ID NO: 974428 - DNA, 25 bp, Mus musculus
tttgcttgcgattaggaactcttaa

SEQ ID NO: 974429 - DNA, 25 bp, Mus musculus
tttgcttgcggcacccaaggtttaa

SEQ ID NO: 974430 - DNA, 25 bp, Mus musculus
tttgcttgcggctcccaaggtttaa

SEQ ID NO: 974431 - DNA, 25 bp, Mus musculus
tttgcttggagaagacacacataag

SEQ ID NO: 974432 - DNA, 25 bp, Mus musculus
tttgcttggagatgacacacataag

SEQ ID NO: 974433 - DNA, 25 bp, Mus musculus
tttgcttggaggatcactttgactt

SEQ ID NO: 974434 - DNA, 25 bp, Mus musculus
tttgcttggaggttcactttgactt

SEQ ID NO: 974435 - DNA, 25 bp, Mus musculus
tttgcttggcatacacatctcaact

SEQ ID NO: 974436 - DNA, 25 bp, Mus musculus
tttgcttggcattcacatctcaact

SEQ ID NO: 974437 - DNA, 25 bp, Mus musculus
tttgcttgggtcacaggcactgctt

SEQ ID NO: 974438 - DNA, 25 bp, Mus musculus
tttgcttgggtctcaggcactgctt

SEQ ID NO: 974439 - DNA, 25 bp, Mus musculus
tttgcttggtagagcagggcatctc

SEQ ID NO: 974440 - DNA, 25 bp, Mus musculus
tttgcttggtagtgcagggcatctc

SEQ ID NO: 974441 - DNA, 25 bp, Mus musculus
tttgcttggtgccatctttgtggca

SEQ ID NO: 974442 - DNA, 25 bp, Mus musculus
tttgcttggtgcgatctttgtggca

SEQ ID NO: 974443 - DNA, 25 bp, Mus musculus
tttgcttggttaacagcagctctgc

SEQ ID NO: 974444 - DNA, 25 bp, Mus musculus
tttgcttggttatcagcagctctgc

SEQ ID NO: 974445 - DNA, 25 bp, Mus musculus
tttgcttgtaaaaatcgctcagtat

SEQ ID NO: 974446 - DNA, 25 bp, Mus musculus
tttgcttgtaaatatcgctcagtat

SEQ ID NO: 974447 - DNA, 25 bp, Mus musculus
tttgcttgtattctgtcagttcata

SEQ ID NO: 974448 - DNA, 25 bp, Mus musculus
tttgcttgtattgtgtcagttcata

SEQ ID NO: 974449 - DNA, 25 bp, Mus musculus
tttgcttgtgatcgccccattttta

SEQ ID NO: 974450 - DNA, 25 bp, Mus musculus
tttgcttgtgatggccccattttta

SEQ ID NO: 974451 - DNA, 25 bp, Mus musculus
tttgcttgttatcaataggcctgga

SEQ ID NO: 974452 - DNA, 25 bp, Mus musculus
tttgcttgttatgaataggcctgga

SEQ ID NO: 974453 - DNA, 25 bp, Mus musculus
tttgcttgttcccagcactgcagaa

SEQ ID NO: 974454 - DNA, 25 bp, Mus musculus
tttgcttgttccgagcactgcagaa

SEQ ID NO: 974455 - DNA, 25 bp, Mus musculus
tttgcttgtttacattttgagacag

SEQ ID NO: 974456 - DNA, 25 bp, Mus musculus
tttgcttgtttagattttgagacag

SEQ ID NO: 974457 - DNA, 25 bp, Mus musculus
tttgcttgtttcacgctcctaattt

SEQ ID NO: 974458 - DNA, 25 bp, Mus musculus
tttgcttgtttctcgctcctaattt

SEQ ID NO: 974459 - DNA, 25 bp, Mus musculus
tttgcttgttttctcaagccaccct

SEQ ID NO: 974460 - DNA, 25 bp, Mus musculus
tttgcttgttttgtcaagccaccct

SEQ ID NO: 974461 - DNA, 25 bp, Mus musculus
tttgctttaactacctgctgcttgt

SEQ ID NO: 974462 - DNA, 25 bp, Mus musculus
tttgctttaacttcctgctgcttgt

SEQ ID NO: 974463 - DNA, 25 bp, Mus musculus
tttgctttacctaatttcatcccac

SEQ ID NO: 974464 - DNA, 25 bp, Mus musculus
tttgctttaccttatttcatcccac

SEQ ID NO: 974465 - DNA, 25 bp, Mus musculus
tttgctttacgcagtccatgggaac

SEQ ID NO: 974466 - DNA, 25 bp, Mus musculus
tttgctttacgctgtccatgggaac

SEQ ID NO: 974467 - DNA, 25 bp, Mus musculus
tttgctttactaaactgctgacttg

SEQ ID NO: 974468 - DNA, 25 bp, Mus musculus
tttgctttactatactgctgacttg

SEQ ID NO: 974469 - DNA, 25 bp, Mus musculus
tttgctttcacacggaatttcccag

SEQ ID NO: 974470 - DNA, 25 bp, Mus musculus
tttgctttcacagggaatttcccag

SEQ ID NO: 974471 - DNA, 25 bp, Mus musculus
tttgctttcaccctgatggcaatct

SEQ ID NO: 974472 - DNA, 25 bp, Mus musculus
tttgctttcaccgtgatggcaatct

SEQ ID NO: 974473 - DNA, 25 bp, Mus musculus
tttgctttcatcacattgttttaaa

SEQ ID NO: 974474 - DNA, 25 bp, Mus musculus
tttgctttcatctcattgttttaaa

SEQ ID NO: 974475 - DNA, 25 bp, Mus musculus
tttgctttcattccgcgccagtgca

SEQ ID NO: 974476 - DNA, 25 bp, Mus musculus
tttgctttcattgcgcgccagtgca

SEQ ID NO: 974477 - DNA, 25 bp, Mus musculus
tttgctttcccaattctatagcagg

SEQ ID NO: 974478 - DNA, 25 bp, Mus musculus
tttgctttcccatttctatagcagg

SEQ ID NO: 974479 - DNA, 25 bp, Mus musculus
tttgctttcgttcgctacaatgtgc

SEQ ID NO: 974480 - DNA, 25 bp, Mus musculus
tttgctttcgttggctacaatgtgc

SEQ ID NO: 974481 - DNA, 25 bp, Mus musculus
tttgctttcttccaggtaccagttg

SEQ ID NO: 974482 - DNA, 25 bp, Mus musculus
tttgctttcttcgaggtaccagttg

SEQ ID NO: 974483 - DNA, 25 bp, Mus musculus
tttgctttctttatgagggtccagt

SEQ ID NO: 974484 - DNA, 25 bp, Mus musculus
tttgctttctttttgagggtccagt

SEQ ID NO: 974485 - DNA, 25 bp, Mus musculus
tttgctttgactaaggtcctcatcc

SEQ ID NO: 974486 - DNA, 25 bp, Mus musculus
tttgctttgacttaggtcctcatcc

SEQ ID NO: 974487 - DNA, 25 bp, Mus musculus
tttgctttgagcacctcgagaacgg

SEQ ID NO: 974488 - DNA, 25 bp, Mus musculus
tttgctttgagctcctcgagaacgg

SEQ ID NO: 974489 - DNA, 25 bp, Mus musculus
tttgctttgattcgcacacttccct

SEQ ID NO: 974490 - DNA, 25 bp, Mus musculus
tttgctttgattggcacacttccct

SEQ ID NO: 974491 - DNA, 25 bp, Mus musculus
tttgctttgcctctgtgctttactt

SEQ ID NO: 974492 - DNA, 25 bp, Mus musculus
tttgctttgcctgtgtgctttactt

SEQ ID NO: 974493 - DNA, 25 bp, Mus musculus
tttgctttgctcatgatggcttcat

SEQ ID NO: 974494 - DNA, 25 bp, Mus musculus
tttgctttgctcttgatggcttcat

SEQ ID NO: 974495 - DNA, 25 bp, Mus musculus
tttgctttgctgaacctcgctagtc

SEQ ID NO: 974496 - DNA, 25 bp, Mus musculus
tttgctttgctgtacctcgctagtc

SEQ ID NO: 974497 - DNA, 25 bp, Mus musculus
tttgctttgcttccgcggaactcac

SEQ ID NO: 974498 - DNA, 25 bp, Mus musculus
tttgctttgcttgcgcggaactcac

SEQ ID NO: 974499 - DNA, 25 bp, Mus musculus
tttgctttggagactcgagccagcc

SEQ ID NO: 974500 - DNA, 25 bp, Mus musculus
tttgctttggagtctcgagccagcc

SEQ ID NO: 974501 - DNA, 25 bp, Mus musculus
tttgctttgtctcactgaaaagatt

SEQ ID NO: 974502 - DNA, 25 bp, Mus musculus
tttgctttgtctgactgaaaagatt

SEQ ID NO: 974503 - DNA, 25 bp, Mus musculus
tttgcttttaaactacaggcgacca

SEQ ID NO: 974504 - DNA, 25 bp, Mus musculus
tttgcttttaaagtacaggcgacca

SEQ ID NO: 974505 - DNA, 25 bp, Mus musculus
tttgcttttattctacagtcagtac

SEQ ID NO: 974506 - DNA, 25 bp, Mus musculus
tttgcttttattgtacagtcagtac

SEQ ID NO: 974507 - DNA, 25 bp, Mus musculus
tttgcttttccgatcactgaagtga

SEQ ID NO: 974508 - DNA, 25 bp, Mus musculus
tttgcttttccgttcactgaagtga

SEQ ID NO: 974509 - DNA, 25 bp, Mus musculus
tttgcttttcctaggccagtttcag

SEQ ID NO: 974510 - DNA, 25 bp, Mus musculus
tttgcttttccttggccagtttcag

SEQ ID NO: 974511 - DNA, 25 bp, Mus musculus
tttgcttttgatctatccctttgtg

SEQ ID NO: 974512 - DNA, 25 bp, Mus musculus
tttgcttttgatgtatccctttgtg

SEQ ID NO: 974513 - DNA, 25 bp, Mus musculus
tttgcttttgcaaggagaacactag

SEQ ID NO: 974514 - DNA, 25 bp, Mus musculus
tttgcttttgcatggagaacactag

SEQ ID NO: 974515 - DNA, 25 bp, Mus musculus
tttgcttttgcgacattttgtgtac

SEQ ID NO: 974516 - DNA, 25 bp, Mus musculus
tttgcttttgcgtcattttgtgtac

SEQ ID NO: 974517 - DNA, 25 bp, Mus musculus
tttgcttttggcctgtagaaagcca

SEQ ID NO: 974518 - DNA, 25 bp, Mus musculus
tttgcttttggcgtgtagaaagcca

SEQ ID NO: 974519 - DNA, 25 bp, Mus musculus
tttgcttttgtcactccatactcag

SEQ ID NO: 974520 - DNA, 25 bp, Mus musculus
tttgcttttgtctctccatactcag

SEQ ID NO: 974521 - DNA, 25 bp, Mus musculus
tttgcttttgtgatattcctttcta

SEQ ID NO: 974522 - DNA, 25 bp, Mus musculus
tttgcttttgtgttattcctttcta

SEQ ID NO: 974523 - DNA, 25 bp, Mus musculus
tttgctttttctctatgttgaataa

SEQ ID NO: 974524 - DNA, 25 bp, Mus musculus
tttgctttttctgtatgttgaataa

SEQ ID NO: 974525 - DNA, 25 bp, Mus musculus
tttgcttttttaattgcctctcaga

SEQ ID NO: 974526 - DNA, 25 bp, Mus musculus
tttgcttttttacttcatgagtcca

SEQ ID NO: 974527 - DNA, 25 bp, Mus musculus
tttgcttttttagttcatgagtcca

SEQ ID NO: 974528 - DNA, 25 bp, Mus musculus
tttgcttttttatttgcctctcaga

SEQ ID NO: 974529 - DNA, 25 bp, Mus musculus
tttggaaaacctcggtgctattgcc

SEQ ID NO: 974530 - DNA, 25 bp, Mus musculus
tttggaaaacctgggtgctattgcc

SEQ ID NO: 974531 - DNA, 25 bp, Mus musculus
tttggaaacagtcctcacaaacttc

SEQ ID NO: 974532 - DNA, 25 bp, Mus musculus
tttggaaacagtgctcacaaacttc

SEQ ID NO: 974533 - DNA, 25 bp, Mus musculus
tttggaaaccagcaagcatctccct

SEQ ID NO: 974534 - DNA, 25 bp, Mus musculus
tttggaaaccaggaagcatctccct

SEQ ID NO: 974535 - DNA, 25 bp, Mus musculus
tttggaaacgtgacaggattggcct

SEQ ID NO: 974536 - DNA, 25 bp, Mus musculus
tttggaaacgtgtcaggattggcct

SEQ ID NO: 974537 - DNA, 25 bp, Mus musculus
tttggaaacgttcgcctcctgatgg

SEQ ID NO: 974538 - DNA, 25 bp, Mus musculus
tttggaaacgttggcctcctgatgg

SEQ ID NO: 974539 - DNA, 25 bp, Mus musculus
tttggaaactatagtcctttggaga

SEQ ID NO: 974540 - DNA, 25 bp, Mus musculus
tttggaaactatccctcctgcggac

SEQ ID NO: 974541 - DNA, 25 bp, Mus musculus
tttggaaactatgcctcctgcggac

SEQ ID NO: 974542 - DNA, 25 bp, Mus musculus
tttggaaactattgtcctttggaga

SEQ ID NO: 974543 - DNA, 25 bp, Mus musculus
tttggaaactccactacgtcagtat

SEQ ID NO: 974544 - DNA, 25 bp, Mus musculus
tttggaaactcccacgtgacacagt

SEQ ID NO: 974545 - DNA, 25 bp, Mus musculus
tttggaaactccgacgtgacacagt

SEQ ID NO: 974546 - DNA, 25 bp, Mus musculus
tttggaaactcctctacgtcagtat

SEQ ID NO: 974547 - DNA, 25 bp, Mus musculus
tttggaaagaacactcctcataggt

SEQ ID NO: 974548 - DNA, 25 bp, Mus musculus
tttggaaagaactctcctcataggt

SEQ ID NO: 974549 - DNA, 25 bp, Mus musculus
tttggaaagcagctacttacccctc

SEQ ID NO: 974550 - DNA, 25 bp, Mus musculus
tttggaaagcaggtacttacccctc

SEQ ID NO: 974551 - DNA, 25 bp, Mus musculus
tttggaaaggaacccggccgtgcct

SEQ ID NO: 974552 - DNA, 25 bp, Mus musculus
tttggaaaggaagccggccgtgcct

SEQ ID NO: 974553 - DNA, 25 bp, Mus musculus
tttggaaataagcatcccgtccagc

SEQ ID NO: 974554 - DNA, 25 bp, Mus musculus
tttggaaataaggatcccgtccagc

SEQ ID NO: 974555 - DNA, 25 bp, Mus musculus
tttggaaatctaaaagcctggactt

SEQ ID NO: 974556 - DNA, 25 bp, Mus musculus
tttggaaatctataagcctggactt

SEQ ID NO: 974557 - DNA, 25 bp, Mus musculus
tttggaaatgagacgtgctggagat

SEQ ID NO: 974558 - DNA, 25 bp, Mus musculus
tttggaaatgagtcgtgctggagat

SEQ ID NO: 974559 - DNA, 25 bp, Mus musculus
tttggaaatgccaagccagctgctc

SEQ ID NO: 974560 - DNA, 25 bp, Mus musculus
tttggaaatgcctagccagctgctc

SEQ ID NO: 974561 - DNA, 25 bp, Mus musculus
tttggaacaacacataaaccctcag

SEQ ID NO: 974562 - DNA, 25 bp, Mus musculus
tttggaacaacagataaaccctcag

SEQ ID NO: 974563 - DNA, 25 bp, Mus musculus
tttggaacagtacccttccttgact

SEQ ID NO: 974564 - DNA, 25 bp, Mus musculus
tttggaacagtagccttccttgact

SEQ ID NO: 974565 - DNA, 25 bp, Mus musculus
tttggaaccaacctgtcttcttgga

SEQ ID NO: 974566 - DNA, 25 bp, Mus musculus
tttggaaccaacgtgtcttcttgga

SEQ ID NO: 974567 - DNA, 25 bp, Mus musculus
tttggaactaccaggagccagcgcc

SEQ ID NO: 974568 - DNA, 25 bp, Mus musculus
tttggaactacctggagccagcgcc

SEQ ID NO: 974569 - DNA, 25 bp, Mus musculus
tttggaactgctaagggccttgcct

SEQ ID NO: 974570 - DNA, 25 bp, Mus musculus
tttggaactgcttagggccttgcct

SEQ ID NO: 974571 - DNA, 25 bp, Mus musculus
tttggaactggtaatccaagcctgg

SEQ ID NO: 974572 - DNA, 25 bp, Mus musculus
tttggaactggttatccaagcctgg

SEQ ID NO: 974573 - DNA, 25 bp, Mus musculus
tttggaacttgtatgctctctagca

SEQ ID NO: 974574 - DNA, 25 bp, Mus musculus
tttggaacttgtttgctctctagca

SEQ ID NO: 974575 - DNA, 25 bp, Mus musculus
tttggaagacatccctggtgctcta

SEQ ID NO: 974576 - DNA, 25 bp, Mus musculus
tttggaagacatgcctggtgctcta

SEQ ID NO: 974577 - DNA, 25 bp, Mus musculus
tttggaagatagatgtggaaccagc

SEQ ID NO: 974578 - DNA, 25 bp, Mus musculus
tttggaagatagttgtggaaccagc

SEQ ID NO: 974579 - DNA, 25 bp, Mus musculus
tttggaagattccttggtgctcatt

SEQ ID NO: 974580 - DNA, 25 bp, Mus musculus
tttggaagattcgttggtgctcatt

SEQ ID NO: 974581 - DNA, 25 bp, Mus musculus
tttggaagccctatctacaccttag

SEQ ID NO: 974582 - DNA, 25 bp, Mus musculus
tttggaagccctttctacaccttag

SEQ ID NO: 974583 - DNA, 25 bp, Mus musculus
tttggaagggtactactgactcact

SEQ ID NO: 974584 - DNA, 25 bp, Mus musculus
tttggaagggtagtactgactcact

SEQ ID NO: 974585 - DNA, 25 bp, Mus musculus
tttggaaggtccacttgtcctgtat

SEQ ID NO: 974586 - DNA, 25 bp, Mus musculus
tttggaaggtcctcttgtcctgtat

SEQ ID NO: 974587 - DNA, 25 bp, Mus musculus
tttggaaggttcctccatgtgacac

SEQ ID NO: 974588 - DNA, 25 bp, Mus musculus
tttggaaggttcgtccatgtgacac

SEQ ID NO: 974589 - DNA, 25 bp, Mus musculus
tttggaagtaggagcggtcgccaca

SEQ ID NO: 974590 - DNA, 25 bp, Mus musculus
tttggaagtaggtgcggtcgccaca

SEQ ID NO: 974591 - DNA, 25 bp, Mus musculus
tttggaagtcagaaaagcacaggca

SEQ ID NO: 974592 - DNA, 25 bp, Mus musculus
tttggaagtcagtaaagcacaggca

SEQ ID NO: 974593 - DNA, 25 bp, Mus musculus
tttggaagtctcagtctgttcctga

SEQ ID NO: 974594 - DNA, 25 bp, Mus musculus
tttggaagtctctgtctgttcctga

SEQ ID NO: 974595 - DNA, 25 bp, Mus musculus
tttggaagtgtaccagttactactg

SEQ ID NO: 974596 - DNA, 25 bp, Mus musculus
tttggaagtgtagcagttactactg

SEQ ID NO: 974597 - DNA, 25 bp, Mus musculus
tttggaagtttactcaccaggcact

SEQ ID NO: 974598 - DNA, 25 bp, Mus musculus
tttggaagtttagtcaccaggcact

SEQ ID NO: 974599 - DNA, 25 bp, Mus musculus
tttggaagtttcatgctctgcattt

SEQ ID NO: 974600 - DNA, 25 bp, Mus musculus
tttggaagtttcttgctctgcattt

SEQ ID NO: 974601 - DNA, 25 bp, Mus musculus
tttggaatcaaaattgtgtattctc

SEQ ID NO: 974602 - DNA, 25 bp, Mus musculus
tttggaatcaaatttgtgtattctc

SEQ ID NO: 974603 - DNA, 25 bp, Mus musculus
tttggaatcaccagcacccactgat

SEQ ID NO: 974604 - DNA, 25 bp, Mus musculus
tttggaatcacctgcacccactgat

SEQ ID NO: 974605 - DNA, 25 bp, Mus musculus
tttggaatctgtattggcattgtca

SEQ ID NO: 974606 - DNA, 25 bp, Mus musculus
tttggaatctgttttggcattgtca

SEQ ID NO: 974607 - DNA, 25 bp, Mus musculus
tttggaatgagacatcagcctggcc

SEQ ID NO: 974608 - DNA, 25 bp, Mus musculus
tttggaatgagacattggtgtgttt

SEQ ID NO: 974609 - DNA, 25 bp, Mus musculus
tttggaatgagagatcagcctggcc

SEQ ID NO: 974610 - DNA, 25 bp, Mus musculus
tttggaatgagagattggtgtgttt

SEQ ID NO: 974611 - DNA, 25 bp, Mus musculus
tttggaatgcgcctgttttctcttt

SEQ ID NO: 974612 - DNA, 25 bp, Mus musculus
tttggaatgcgcgtgttttctcttt

SEQ ID NO: 974613 - DNA, 25 bp, Mus musculus
tttggaatgctcagactatcttgtc

SEQ ID NO: 974614 - DNA, 25 bp, Mus musculus
tttggaatgctctgactatcttgtc

SEQ ID NO: 974615 - DNA, 25 bp, Mus musculus
tttggaatggttcggtgtcatcctc

SEQ ID NO: 974616 - DNA, 25 bp, Mus musculus
tttggaatggttgggtgtcatcctc

SEQ ID NO: 974617 - DNA, 25 bp, Mus musculus
tttggaattactcacttctaagatt

SEQ ID NO: 974618 - DNA, 25 bp, Mus musculus
tttggaattactgacttctaagatt

SEQ ID NO: 974619 - DNA, 25 bp, Mus musculus
tttggaattctgcagtatcctgaag

SEQ ID NO: 974620 - DNA, 25 bp, Mus musculus
tttggaattctggagtatcctgaag

SEQ ID NO: 974621 - DNA, 25 bp, Mus musculus
tttggacaactgctgacttctggcc

SEQ ID NO: 974622 - DNA, 25 bp, Mus musculus
tttggacaactggtgacttctggcc

SEQ ID NO: 974623 - DNA, 25 bp, Mus musculus
tttggacaacttcacgctggttaac

SEQ ID NO: 974624 - DNA, 25 bp, Mus musculus
tttggacaacttgacgctggttaac

SEQ ID NO: 974625 - DNA, 25 bp, Mus musculus
tttggacaagtcatcagtggtaaat

SEQ ID NO: 974626 - DNA, 25 bp, Mus musculus
tttggacaagtcttcagtggtaaat

SEQ ID NO: 974627 - DNA, 25 bp, Mus musculus
tttggacactctcctggcacttggg

SEQ ID NO: 974628 - DNA, 25 bp, Mus musculus
tttggacactctgctggcacttggg

SEQ ID NO: 974629 - DNA, 25 bp, Mus musculus
tttggacactgcctgtgatagctac

SEQ ID NO: 974630 - DNA, 25 bp, Mus musculus
tttggacactgcgtgtgatagctac

SEQ ID NO: 974631 - DNA, 25 bp, Mus musculus
tttggacacttgcatctaaacgatg

SEQ ID NO: 974632 - DNA, 25 bp, Mus musculus
tttggacacttggatctaaacgatg

SEQ ID NO: 974633 - DNA, 25 bp, Mus musculus
tttggacagccaccatgtgcctttg

SEQ ID NO: 974634 - DNA, 25 bp, Mus musculus
tttggacagccagcatgtgcctttg

SEQ ID NO: 974635 - DNA, 25 bp, Mus musculus
tttggacatagcaccaggcgacatg

SEQ ID NO: 974636 - DNA, 25 bp, Mus musculus
tttggacatagctccaggcgacatg

SEQ ID NO: 974637 - DNA, 25 bp, Mus musculus
tttggacatttgatcaggaatacta

SEQ ID NO: 974638 - DNA, 25 bp, Mus musculus
tttggacatttgttcaggaatacta

SEQ ID NO: 974639 - DNA, 25 bp, Mus musculus
tttggaccacaaattctcagtagac

SEQ ID NO: 974640 - DNA, 25 bp, Mus musculus
tttggaccacaatttctcagtagac

SEQ ID NO: 974641 - DNA, 25 bp, Mus musculus
tttggaccacagaccctagtgagca

SEQ ID NO: 974642 - DNA, 25 bp, Mus musculus
tttggaccacagtccctagtgagca

SEQ ID NO: 974643 - DNA, 25 bp, Mus musculus
tttggaccatgaatctcccgggcac

SEQ ID NO: 974644 - DNA, 25 bp, Mus musculus
tttggaccatgattctcccgggcac

SEQ ID NO: 974645 - DNA, 25 bp, Mus musculus
tttggaccctaaaggaatccaggac

SEQ ID NO: 974646 - DNA, 25 bp, Mus musculus
tttggaccctaatggaatccaggac

SEQ ID NO: 974647 - DNA, 25 bp, Mus musculus
tttggaccctggactcggtatacct

SEQ ID NO: 974648 - DNA, 25 bp, Mus musculus
tttggaccctggtctcggtatacct

SEQ ID NO: 974649 - DNA, 25 bp, Mus musculus
tttggaccctgtatgcctgttacac

SEQ ID NO: 974650 - DNA, 25 bp, Mus musculus
tttggaccctgtttgcctgttacac

SEQ ID NO: 974651 - DNA, 25 bp, Mus musculus
tttggaccgttcagtggcatcgaca

SEQ ID NO: 974652 - DNA, 25 bp, Mus musculus
tttggaccgttctgtggcatcgaca

SEQ ID NO: 974653 - DNA, 25 bp, Mus musculus
tttggacctatcaacagtattgcct

SEQ ID NO: 974654 - DNA, 25 bp, Mus musculus
tttggacctatctacagtattgcct

SEQ ID NO: 974655 - DNA, 25 bp, Mus musculus
tttggacctgatcccaactgccaag

SEQ ID NO: 974656 - DNA, 25 bp, Mus musculus
tttggacctgatgccaactgccaag

SEQ ID NO: 974657 - DNA, 25 bp, Mus musculus
tttggaccttacagccactttggac

SEQ ID NO: 974658 - DNA, 25 bp, Mus musculus
tttggaccttactgccactttggac

SEQ ID NO: 974659 - DNA, 25 bp, Mus musculus
tttggacgatggctttcaagacact

SEQ ID NO: 974660 - DNA, 25 bp, Mus musculus
tttggacgatgggtttcaagacact

SEQ ID NO: 974661 - DNA, 25 bp, Mus musculus
tttggacgcgggatttggccactgt

SEQ ID NO: 974662 - DNA, 25 bp, Mus musculus
tttggacgcgggttttggccactgt

SEQ ID NO: 974663 - DNA, 25 bp, Mus musculus
tttggacgctcactactgccttcac

SEQ ID NO: 974664 - DNA, 25 bp, Mus musculus
tttggacgctcagtactgccttcac

SEQ ID NO: 974665 - DNA, 25 bp, Mus musculus
tttggacggacaatggcatgcccct

SEQ ID NO: 974666 - DNA, 25 bp, Mus musculus
tttggacggacattggcatgcccct

SEQ ID NO: 974667 - DNA, 25 bp, Mus musculus
tttggacggtgtcccggactcctga

SEQ ID NO: 974668 - DNA, 25 bp, Mus musculus
tttggacggtgtgccggactcctga

SEQ ID NO: 974669 - DNA, 25 bp, Mus musculus
tttggactaattccatcctatttgg

SEQ ID NO: 974670 - DNA, 25 bp, Mus musculus
tttggactaattgcatcctatttgg

SEQ ID NO: 974671 - DNA, 25 bp, Mus musculus
tttggactccaaccttactcagttt

SEQ ID NO: 974672 - DNA, 25 bp, Mus musculus
tttggactccaagcttactcagttt

SEQ ID NO: 974673 - DNA, 25 bp, Mus musculus
tttggactccagattatactccttt

SEQ ID NO: 974674 - DNA, 25 bp, Mus musculus
tttggactccagtttatactccttt

SEQ ID NO: 974675 - DNA, 25 bp, Mus musculus
tttggactccataaggctggcttct

SEQ ID NO: 974676 - DNA, 25 bp, Mus musculus
tttggactccattaggctggcttct

SEQ ID NO: 974677 - DNA, 25 bp, Mus musculus
tttggactcccaattcctggtcatt

SEQ ID NO: 974678 - DNA, 25 bp, Mus musculus
tttggactcccatttcctggtcatt

SEQ ID NO: 974679 - DNA, 25 bp, Mus musculus
tttggactcgtcattctaaccttta

SEQ ID NO: 974680 - DNA, 25 bp, Mus musculus
tttggactcgtctttctaaccttta

SEQ ID NO: 974681 - DNA, 25 bp, Mus musculus
tttggactctgtcagcatgtctctt

SEQ ID NO: 974682 - DNA, 25 bp, Mus musculus
tttggactctgtgagcatgtctctt

SEQ ID NO: 974683 - DNA, 25 bp, Mus musculus
tttggactggatcggaataaccaaa

SEQ ID NO: 974684 - DNA, 25 bp, Mus musculus
tttggactggatcttcctctccagc

SEQ ID NO: 974685 - DNA, 25 bp, Mus musculus
tttggactggatgggaataaccaaa

SEQ ID NO: 974686 - DNA, 25 bp, Mus musculus
tttggactggatgttcctctccagc

SEQ ID NO: 974687 - DNA, 25 bp, Mus musculus
tttggacttgcaaatttagctgttt

SEQ ID NO: 974688 - DNA, 25 bp, Mus musculus
tttggacttgcatatttagctgttt

SEQ ID NO: 974689 - DNA, 25 bp, Mus musculus
tttggacttgcgaatttagccccct

SEQ ID NO: 974690 - DNA, 25 bp, Mus musculus
tttggacttgcgtatttagccccct

SEQ ID NO: 974691 - DNA, 25 bp, Mus musculus
tttggacttggcaccgttgcacccc

SEQ ID NO: 974692 - DNA, 25 bp, Mus musculus
tttggacttggctccgttgcacccc

SEQ ID NO: 974693 - DNA, 25 bp, Mus musculus
tttggactttctagttccgaaggct

SEQ ID NO: 974694 - DNA, 25 bp, Mus musculus
tttggactttcttgttccgaaggct

SEQ ID NO: 974695 - DNA, 25 bp, Mus musculus
tttggagaaaatcggctgctgtgct

SEQ ID NO: 974696 - DNA, 25 bp, Mus musculus
tttggagaaaatgggctgctgtgct

SEQ ID NO: 974697 - DNA, 25 bp, Mus musculus
tttggagaaacaatcccagctgtaa

SEQ ID NO: 974698 - DNA, 25 bp, Mus musculus
tttggagaaacattcccagctgtaa

SEQ ID NO: 974699 - DNA, 25 bp, Mus musculus
tttggagaactgaccctaccatctg

SEQ ID NO: 974700 - DNA, 25 bp, Mus musculus
tttggagaactgtccctaccatctg

SEQ ID NO: 974701 - DNA, 25 bp, Mus musculus
tttggagaccagattaggaaacttg

SEQ ID NO: 974702 - DNA, 25 bp, Mus musculus
tttggagaccagtttaggaaacttg

SEQ ID NO: 974703 - DNA, 25 bp, Mus musculus
tttggagacccaaaagcacctcact

SEQ ID NO: 974704 - DNA, 25 bp, Mus musculus
tttggagacccacgcttggccgcaa

SEQ ID NO: 974705 - DNA, 25 bp, Mus musculus
tttggagacccaggcttggccgcaa

SEQ ID NO: 974706 - DNA, 25 bp, Mus musculus
tttggagacccataagcacctcact

SEQ ID NO: 974707 - DNA, 25 bp, Mus musculus
tttggagaccgacgctgttatcagc

SEQ ID NO: 974708 - DNA, 25 bp, Mus musculus
tttggagaccgaggctgttatcagc

SEQ ID NO: 974709 - DNA, 25 bp, Mus musculus
tttggagacctaacctctgcctctg

SEQ ID NO: 974710 - DNA, 25 bp, Mus musculus
tttggagacctatcctctgcctctg

SEQ ID NO: 974711 - DNA, 25 bp, Mus musculus
tttggagacctcctgattgcccctg

SEQ ID NO: 974712 - DNA, 25 bp, Mus musculus
tttggagacctcgtgattgcccctg

SEQ ID NO: 974713 - DNA, 25 bp, Mus musculus
tttggagacctgacagtggaaccca

SEQ ID NO: 974714 - DNA, 25 bp, Mus musculus
tttggagacctgtcagtggaaccca

SEQ ID NO: 974715 - DNA, 25 bp, Mus musculus
tttggagactcaactttttgccctg

SEQ ID NO: 974716 - DNA, 25 bp, Mus musculus
tttggagactcatctttttgccctg

SEQ ID NO: 974717 - DNA, 25 bp, Mus musculus
tttggagactcgagaccaccttact

SEQ ID NO: 974718 - DNA, 25 bp, Mus musculus
tttggagactcgtgaccaccttact

SEQ ID NO: 974719 - DNA, 25 bp, Mus musculus
tttggagagcctcttcctgtcagta

SEQ ID NO: 974720 - DNA, 25 bp, Mus musculus
tttggagagcctgttcctgtcagta

SEQ ID NO: 974721 - DNA, 25 bp, Mus musculus
tttggagatccccatgagtctgcat

SEQ ID NO: 974722 - DNA, 25 bp, Mus musculus
tttggagatcccgatgagtctgcat

SEQ ID NO: 974723 - DNA, 25 bp, Mus musculus
tttggagatcttatgtgtctatggt

SEQ ID NO: 974724 - DNA, 25 bp, Mus musculus
tttggagatcttttgtgtctatggt

SEQ ID NO: 974725 - DNA, 25 bp, Mus musculus
tttggagatgcgcaacggactctct

SEQ ID NO: 974726 - DNA, 25 bp, Mus musculus
tttggagatgcggaacggactctct

SEQ ID NO: 974727 - DNA, 25 bp, Mus musculus
tttggagattcactggctctgttcc

SEQ ID NO: 974728 - DNA, 25 bp, Mus musculus
tttggagattcagtggctctgttcc

SEQ ID NO: 974729 - DNA, 25 bp, Mus musculus
tttggagcagctcgcatcagtccgg

SEQ ID NO: 974730 - DNA, 25 bp, Mus musculus
tttggagcagctggcatcagtccgg

SEQ ID NO: 974731 - DNA, 25 bp, Mus musculus
tttggagcatccctaccagaatttt

SEQ ID NO: 974732 - DNA, 25 bp, Mus musculus
tttggagcatccgtaccagaatttt

SEQ ID NO: 974733 - DNA, 25 bp, Mus musculus
tttggagcatttcagatcagtagtt

SEQ ID NO: 974734 - DNA, 25 bp, Mus musculus
tttggagcatttgagatcagtagtt

SEQ ID NO: 974735 - DNA, 25 bp, Mus musculus
tttggagccaacctgaacctggtga

SEQ ID NO: 974736 - DNA, 25 bp, Mus musculus
tttggagccaacgtgaacctggtga

SEQ ID NO: 974737 - DNA, 25 bp, Mus musculus
tttggagcccaaaacatcagcagtg

SEQ ID NO: 974738 - DNA, 25 bp, Mus musculus
tttggagcccaatacatcagcagtg

SEQ ID NO: 974739 - DNA, 25 bp, Mus musculus
tttggagcccatcaaccctgatgcc

SEQ ID NO: 974740 - DNA, 25 bp, Mus musculus
tttggagcccatgaaccctgatgcc

SEQ ID NO: 974741 - DNA, 25 bp, Mus musculus
tttggagcccctccgcaagttccgt

SEQ ID NO: 974742 - DNA, 25 bp, Mus musculus
tttggagcccctgcgcaagttccgt

SEQ ID NO: 974743 - DNA, 25 bp, Mus musculus
tttggagcctgtacggtactgctgg

SEQ ID NO: 974744 - DNA, 25 bp, Mus musculus
tttggagcctgttcggtactgctgg

SEQ ID NO: 974745 - DNA, 25 bp, Mus musculus
tttggagcgggcaacttcaactctc

SEQ ID NO: 974746 - DNA, 25 bp, Mus musculus
tttggagcgggctacttcaactctc

SEQ ID NO: 974747 - DNA, 25 bp, Mus musculus
tttggagctgggattcggttcctgt

SEQ ID NO: 974748 - DNA, 25 bp, Mus musculus
tttggagctgggtttcggttcctgt

SEQ ID NO: 974749 - DNA, 25 bp, Mus musculus
tttggaggatagctcaggtgcgtta

SEQ ID NO: 974750 - DNA, 25 bp, Mus musculus
tttggaggataggtcaggtgcgtta

SEQ ID NO: 974751 - DNA, 25 bp, Mus musculus
tttggaggcaaacgtccctttggtg

SEQ ID NO: 974752 - DNA, 25 bp, Mus musculus
tttggaggcaaaggtccctttggtg

SEQ ID NO: 974753 - DNA, 25 bp, Mus musculus
tttggaggcacaactccctagggta

SEQ ID NO: 974754 - DNA, 25 bp, Mus musculus
tttggaggcacatctccctagggta

SEQ ID NO: 974755 - DNA, 25 bp, Mus musculus
tttggaggccgaccttcccatgggt

SEQ ID NO: 974756 - DNA, 25 bp, Mus musculus
tttggaggccgagcttcccatgggt

SEQ ID NO: 974757 - DNA, 25 bp, Mus musculus
tttggagggtctagtggtccagttt

SEQ ID NO: 974758 - DNA, 25 bp, Mus musculus
tttggagggtcttgtggtccagttt

SEQ ID NO: 974759 - DNA, 25 bp, Mus musculus
tttggaggtccgaggaagaacctga

SEQ ID NO: 974760 - DNA, 25 bp, Mus musculus
tttggaggtccgtggaagaacctga

SEQ ID NO: 974761 - DNA, 25 bp, Mus musculus
tttggaggtgctagatctatctaca

SEQ ID NO: 974762 - DNA, 25 bp, Mus musculus
tttggaggtgcttgatctatctaca

SEQ ID NO: 974763 - DNA, 25 bp, Mus musculus
tttggaggttgtcccattaagagcc

SEQ ID NO: 974764 - DNA, 25 bp, Mus musculus
tttggaggttgtgccattaagagcc

SEQ ID NO: 974765 - DNA, 25 bp, Mus musculus
tttggagtacccctgtctatgccgc

SEQ ID NO: 974766 - DNA, 25 bp, Mus musculus
tttggagtacccgtgtctatgccgc

SEQ ID NO: 974767 - DNA, 25 bp, Mus musculus
tttggagtactaactgatccccttc

SEQ ID NO: 974768 - DNA, 25 bp, Mus musculus
tttggagtactatctgatccccttc

SEQ ID NO: 974769 - DNA, 25 bp, Mus musculus
tttggagtagaaatatcgcccgaag

SEQ ID NO: 974770 - DNA, 25 bp, Mus musculus
tttggagtagaattatcgcccgaag

SEQ ID NO: 974771 - DNA, 25 bp, Mus musculus
tttggagtagttcgcatgcctctct

SEQ ID NO: 974772 - DNA, 25 bp, Mus musculus
tttggagtagttggcatgcctctct

SEQ ID NO: 974773 - DNA, 25 bp, Mus musculus
tttggagtcccaatcctggagagca

SEQ ID NO: 974774 - DNA, 25 bp, Mus musculus
tttggagtcccattcctggagagca

SEQ ID NO: 974775 - DNA, 25 bp, Mus musculus
tttggagtctcccatcgtgctaccg

SEQ ID NO: 974776 - DNA, 25 bp, Mus musculus
tttggagtctccgatcgtgctaccg

SEQ ID NO: 974777 - DNA, 25 bp, Mus musculus
tttggagtgctgactcatggaggcc

SEQ ID NO: 974778 - DNA, 25 bp, Mus musculus
tttggagtgctgtctcatggaggcc

SEQ ID NO: 974779 - DNA, 25 bp, Mus musculus
tttggagttaccagtggctttgagt

SEQ ID NO: 974780 - DNA, 25 bp, Mus musculus
tttggagttacctgtggctttgagt

SEQ ID NO: 974781 - DNA, 25 bp, Mus musculus
tttggagttgccctgctttccttac

SEQ ID NO: 974782 - DNA, 25 bp, Mus musculus
tttggagttgccgtgctttccttac

SEQ ID NO: 974783 - DNA, 25 bp, Mus musculus
tttggagttgtcctcacatctgttt

SEQ ID NO: 974784 - DNA, 25 bp, Mus musculus
tttggagttgtcgtcacatctgttt

SEQ ID NO: 974785 - DNA, 25 bp, Mus musculus
tttggagtttggagttcccgcagcc

SEQ ID NO: 974786 - DNA, 25 bp, Mus musculus
tttggagtttggtgttcccgcagcc

SEQ ID NO: 974787 - DNA, 25 bp, Mus musculus
tttggataatacattctcaggtgct

SEQ ID NO: 974788 - DNA, 25 bp, Mus musculus
tttggataatactttctcaggtgct

SEQ ID NO: 974789 - DNA, 25 bp, Mus musculus
tttggatacattacacttggataac

SEQ ID NO: 974790 - DNA, 25 bp, Mus musculus
tttggatacatttcacttggataac

SEQ ID NO: 974791 - DNA, 25 bp, Mus musculus
tttggatacccacctgcaagtcatg

SEQ ID NO: 974792 - DNA, 25 bp, Mus musculus
tttggatacccagctgcaagtcatg

SEQ ID NO: 974793 - DNA, 25 bp, Mus musculus
tttggatacctactagagcatcttt

SEQ ID NO: 974794 - DNA, 25 bp, Mus musculus
tttggatacctagtagagcatcttt

SEQ ID NO: 974795 - DNA, 25 bp, Mus musculus
tttggatacttacctgccttttcat

SEQ ID NO: 974796 - DNA, 25 bp, Mus musculus
tttggatacttagctgccttttcat

SEQ ID NO: 974797 - DNA, 25 bp, Mus musculus
tttggatagtgcacttcccacaact

SEQ ID NO: 974798 - DNA, 25 bp, Mus musculus
tttggatagtgctcttcccacaact

SEQ ID NO: 974799 - DNA, 25 bp, Mus musculus
tttggatcagtcacaacctagcttt

SEQ ID NO: 974800 - DNA, 25 bp, Mus musculus
tttggatcagtctcaacctagcttt

SEQ ID NO: 974801 - DNA, 25 bp, Mus musculus
tttggatccagcaaaacgcgggttt

SEQ ID NO: 974802 - DNA, 25 bp, Mus musculus
tttggatccagcacttatcaggcca

SEQ ID NO: 974803 - DNA, 25 bp, Mus musculus
tttggatccagctaaacgcgggttt

SEQ ID NO: 974804 - DNA, 25 bp, Mus musculus
tttggatccagctcttatcaggcca

SEQ ID NO: 974805 - DNA, 25 bp, Mus musculus
tttggatcctgcaagagcactgact

SEQ ID NO: 974806 - DNA, 25 bp, Mus musculus
tttggatcctgcattagcaagtgaa

SEQ ID NO: 974807 - DNA, 25 bp, Mus musculus
tttggatcctgctagagcactgact

SEQ ID NO: 974808 - DNA, 25 bp, Mus musculus
tttggatcctgctttagcaagtgaa

SEQ ID NO: 974809 - DNA, 25 bp, Mus musculus
tttggatctcccagggttcacccgg

SEQ ID NO: 974810 - DNA, 25 bp, Mus musculus
tttggatctccctgggttcacccgg

SEQ ID NO: 974811 - DNA, 25 bp, Mus musculus
tttggatctctcctgcataccttct

SEQ ID NO: 974812 - DNA, 25 bp, Mus musculus
tttggatctctcgtgcataccttct

SEQ ID NO: 974813 - DNA, 25 bp, Mus musculus
tttggatcttcccaggctgatgccc

SEQ ID NO: 974814 - DNA, 25 bp, Mus musculus
tttggatcttccgaggctgatgccc

SEQ ID NO: 974815 - DNA, 25 bp, Mus musculus
tttggatgacacctgtggaccggaa

SEQ ID NO: 974816 - DNA, 25 bp, Mus musculus
tttggatgacacgtgtggaccggaa

SEQ ID NO: 974817 - DNA, 25 bp, Mus musculus
tttggatgataaagtcaagtccctc

SEQ ID NO: 974818 - DNA, 25 bp, Mus musculus
tttggatgataatgtcaagtccctc

SEQ ID NO: 974819 - DNA, 25 bp, Mus musculus
tttggatgattcaggaccctccatt

SEQ ID NO: 974820 - DNA, 25 bp, Mus musculus
tttggatgattctggaccctccatt

SEQ ID NO: 974821 - DNA, 25 bp, Mus musculus
tttggatgcacaaagcttgcgattc

SEQ ID NO: 974822 - DNA, 25 bp, Mus musculus
tttggatgcacatagcttgcgattc

SEQ ID NO: 974823 - DNA, 25 bp, Mus musculus
tttggatgccaacacagcagctggg

SEQ ID NO: 974824 - DNA, 25 bp, Mus musculus
tttggatgccaagacagcagctggg

SEQ ID NO: 974825 - DNA, 25 bp, Mus musculus
tttggatgcgggatctatctcacag

SEQ ID NO: 974826 - DNA, 25 bp, Mus musculus
tttggatgcgggttctatctcacag

SEQ ID NO: 974827 - DNA, 25 bp, Mus musculus
tttggatgcgttacccagagtgcca

SEQ ID NO: 974828 - DNA, 25 bp, Mus musculus
tttggatgcgtttcccagagtgcca

SEQ ID NO: 974829 - DNA, 25 bp, Mus musculus
tttggatgctaacctcgtgtctcct

SEQ ID NO: 974830 - DNA, 25 bp, Mus musculus
tttggatgctaagctcgtgtctcct

SEQ ID NO: 974831 - DNA, 25 bp, Mus musculus
tttggatgctcaccttatcctttgc

SEQ ID NO: 974832 - DNA, 25 bp, Mus musculus
tttggatgctcagcttatcctttgc

SEQ ID NO: 974833 - DNA, 25 bp, Mus musculus
tttggatggcatacactcactactt

SEQ ID NO: 974834 - DNA, 25 bp, Mus musculus
tttggatggcattcactcactactt

SEQ ID NO: 974835 - DNA, 25 bp, Mus musculus
tttggatggccacaatcttgccact

SEQ ID NO: 974836 - DNA, 25 bp, Mus musculus
tttggatggccagaatcttgccact

SEQ ID NO: 974837 - DNA, 25 bp, Mus musculus
tttggatgtgatctttttgctttgg

SEQ ID NO: 974838 - DNA, 25 bp, Mus musculus
tttggatgtgatgtttttgctttgg

SEQ ID NO: 974839 - DNA, 25 bp, Mus musculus
tttggatgttgaaagttcacgacat

SEQ ID NO: 974840 - DNA, 25 bp, Mus musculus
tttggatgttgatagttcacgacat

SEQ ID NO: 974841 - DNA, 25 bp, Mus musculus
tttggattcaaacatttacgtagta

SEQ ID NO: 974842 - DNA, 25 bp, Mus musculus
tttggattcaaagatttacgtagta

SEQ ID NO: 974843 - DNA, 25 bp, Mus musculus
tttggattcagaacccacttcggtg

SEQ ID NO: 974844 - DNA, 25 bp, Mus musculus
tttggattcagatcccacttcggtg

SEQ ID NO: 974845 - DNA, 25 bp, Mus musculus
tttggattcctactgctcaagtggc

SEQ ID NO: 974846 - DNA, 25 bp, Mus musculus
tttggattcctagtgctcaagtggc

SEQ ID NO: 974847 - DNA, 25 bp, Mus musculus
tttggattccttacagcattcttgt

SEQ ID NO: 974848 - DNA, 25 bp, Mus musculus
tttggattcctttcagcattcttgt

SEQ ID NO: 974849 - DNA, 25 bp, Mus musculus
tttggatttcaaagcctggttggac

SEQ ID NO: 974850 - DNA, 25 bp, Mus musculus
tttggatttcaacctcaggccgagt

SEQ ID NO: 974851 - DNA, 25 bp, Mus musculus
tttggatttcaagctcaggccgagt

SEQ ID NO: 974852 - DNA, 25 bp, Mus musculus
tttggatttcaatgcctggttggac

SEQ ID NO: 974853 - DNA, 25 bp, Mus musculus
tttggatttccgctttgcggagatg

SEQ ID NO: 974854 - DNA, 25 bp, Mus musculus
tttggatttccggtttgcggagatg

SEQ ID NO: 974855 - DNA, 25 bp, Mus musculus
tttggatttgccatcctctgctgga

SEQ ID NO: 974856 - DNA, 25 bp, Mus musculus
tttggatttgccttcctctgctgga

SEQ ID NO: 974857 - DNA, 25 bp, Mus musculus
tttggatttttccctgacccctgag

SEQ ID NO: 974858 - DNA, 25 bp, Mus musculus
tttggatttttcgctgacccctgag

SEQ ID NO: 974859 - DNA, 25 bp, Mus musculus
tttggcaaagagcaagctacatttt

SEQ ID NO: 974860 - DNA, 25 bp, Mus musculus
tttggcaaagaggaagctacatttt

SEQ ID NO: 974861 - DNA, 25 bp, Mus musculus
tttggcaaccatattaacatcagag

SEQ ID NO: 974862 - DNA, 25 bp, Mus musculus
tttggcaaccattttaacatcagag

SEQ ID NO: 974863 - DNA, 25 bp, Mus musculus
tttggcaactgcctcattcacctgc

SEQ ID NO: 974864 - DNA, 25 bp, Mus musculus
tttggcaactgcgtcattcacctgc

SEQ ID NO: 974865 - DNA, 25 bp, Mus musculus
tttggcaagccgcacttaacagtcc

SEQ ID NO: 974866 - DNA, 25 bp, Mus musculus
tttggcaagccggacttaacagtcc

SEQ ID NO: 974867 - DNA, 25 bp, Mus musculus
tttggcaagtttcaactgtccctgt

SEQ ID NO: 974868 - DNA, 25 bp, Mus musculus
tttggcaagtttgaactgtccctgt

SEQ ID NO: 974869 - DNA, 25 bp, Mus musculus
tttggcacacagactccagctattt

SEQ ID NO: 974870 - DNA, 25 bp, Mus musculus
tttggcacacagtctccagctattt

SEQ ID NO: 974871 - DNA, 25 bp, Mus musculus
tttggcacatttattactgagcagc

SEQ ID NO: 974872 - DNA, 25 bp, Mus musculus
tttggcacattttttactgagcagc

SEQ ID NO: 974873 - DNA, 25 bp, Mus musculus
tttggcaccattcgaatgaggccca

SEQ ID NO: 974874 - DNA, 25 bp, Mus musculus
tttggcaccattggaatgaggccca

SEQ ID NO: 974875 - DNA, 25 bp, Mus musculus
tttggcaccgacagggccgtgtaca

SEQ ID NO: 974876 - DNA, 25 bp, Mus musculus
tttggcaccgactgggccgtgtaca

SEQ ID NO: 974877 - DNA, 25 bp, Mus musculus
tttggcaccttcactctttccaaaa

SEQ ID NO: 974878 - DNA, 25 bp, Mus musculus
tttggcaccttctctctttccaaaa

SEQ ID NO: 974879 - DNA, 25 bp, Mus musculus
tttggcactacgcagttgtgtagca

SEQ ID NO: 974880 - DNA, 25 bp, Mus musculus
tttggcactacggagttgtgtagca

SEQ ID NO: 974881 - DNA, 25 bp, Mus musculus
tttggcactctgctgctgtctgagc

SEQ ID NO: 974882 - DNA, 25 bp, Mus musculus
tttggcactctggtgctgtctgagc

SEQ ID NO: 974883 - DNA, 25 bp, Mus musculus
tttggcactgaaaaacacccaggca

SEQ ID NO: 974884 - DNA, 25 bp, Mus musculus
tttggcactgaataacacccaggca

SEQ ID NO: 974885 - DNA, 25 bp, Mus musculus
tttggcactgcgatcgatctagagt

SEQ ID NO: 974886 - DNA, 25 bp, Mus musculus
tttggcactgcgttcgatctagagt

SEQ ID NO: 974887 - DNA, 25 bp, Mus musculus
tttggcactgtgatggactcgttat

SEQ ID NO: 974888 - DNA, 25 bp, Mus musculus
tttggcactgtgttggactcgttat

SEQ ID NO: 974889 - DNA, 25 bp, Mus musculus
tttggcagaccaatagtcggcacca

SEQ ID NO: 974890 - DNA, 25 bp, Mus musculus
tttggcagaccattagtcggcacca

SEQ ID NO: 974891 - DNA, 25 bp, Mus musculus
tttggcagagatcccacattttctt

SEQ ID NO: 974892 - DNA, 25 bp, Mus musculus
tttggcagagatgccacattttctt

SEQ ID NO: 974893 - DNA, 25 bp, Mus musculus
tttggcagcaacataaacctcgagg

SEQ ID NO: 974894 - DNA, 25 bp, Mus musculus
tttggcagcaacttaaacctcgagg

SEQ ID NO: 974895 - DNA, 25 bp, Mus musculus
tttggcagcacccttactctagaac

SEQ ID NO: 974896 - DNA, 25 bp, Mus musculus
tttggcagcaccgttactctagaac

SEQ ID NO: 974897 - DNA, 25 bp, Mus musculus
tttggcagccagcttttctaggagc

SEQ ID NO: 974898 - DNA, 25 bp, Mus musculus
tttggcagccaggttttctaggagc

SEQ ID NO: 974899 - DNA, 25 bp, Mus musculus
tttggcagccttagtttcttcttat

SEQ ID NO: 974900 - DNA, 25 bp, Mus musculus
tttggcagccttcatcttttcctaa

SEQ ID NO: 974901 - DNA, 25 bp, Mus musculus
tttggcagccttgatcttttcctaa

SEQ ID NO: 974902 - DNA, 25 bp, Mus musculus
tttggcagcctttgtttcttcttat

SEQ ID NO: 974903 - DNA, 25 bp, Mus musculus
tttggcagctttcactcttacctta

SEQ ID NO: 974904 - DNA, 25 bp, Mus musculus
tttggcagctttgactcttacctta

SEQ ID NO: 974905 - DNA, 25 bp, Mus musculus
tttggcaggcaactccagacgcaat

SEQ ID NO: 974906 - DNA, 25 bp, Mus musculus
tttggcaggcaagtccagacgcaat

SEQ ID NO: 974907 - DNA, 25 bp, Mus musculus
tttggcaggctccatcttagtttgc

SEQ ID NO: 974908 - DNA, 25 bp, Mus musculus
tttggcaggctcgatcttagtttgc

SEQ ID NO: 974909 - DNA, 25 bp, Mus musculus
tttggcagtaggctcgtctctctga

SEQ ID NO: 974910 - DNA, 25 bp, Mus musculus
tttggcagtagggtcgtctctctga

SEQ ID NO: 974911 - DNA, 25 bp, Mus musculus
tttggcagtccaaggcttgctagcg

SEQ ID NO: 974912 - DNA, 25 bp, Mus musculus
tttggcagtccatggcttgctagcg

SEQ ID NO: 974913 - DNA, 25 bp, Mus musculus
tttggcagtgccacatctggaggca

SEQ ID NO: 974914 - DNA, 25 bp, Mus musculus
tttggcagtgcctcatctggaggca

SEQ ID NO: 974915 - DNA, 25 bp, Mus musculus
tttggcagttcgatgggtcctctaa

SEQ ID NO: 974916 - DNA, 25 bp, Mus musculus
tttggcagttcgttgggtcctctaa

SEQ ID NO: 974917 - DNA, 25 bp, Mus musculus
tttggcagtttgcgtttctgtgttt

SEQ ID NO: 974918 - DNA, 25 bp, Mus musculus
tttggcagtttgggtttctgtgttt

SEQ ID NO: 974919 - DNA, 25 bp, Mus musculus
tttggcatatttcggtagctgttaa

SEQ ID NO: 974920 - DNA, 25 bp, Mus musculus
tttggcatatttgggtagctgttaa

SEQ ID NO: 974921 - DNA, 25 bp, Mus musculus
tttggcatccacaacaatgtcttcg

SEQ ID NO: 974922 - DNA, 25 bp, Mus musculus
tttggcatccactacaatgtcttcg

SEQ ID NO: 974923 - DNA, 25 bp, Mus musculus
tttggcatcttgatctcagctgcac

SEQ ID NO: 974924 - DNA, 25 bp, Mus musculus
tttggcatcttgttctcagctgcac

SEQ ID NO: 974925 - DNA, 25 bp, Mus musculus
tttggcatgattccatctcgttcac

SEQ ID NO: 974926 - DNA, 25 bp, Mus musculus
tttggcatgattgcatctcgttcac

SEQ ID NO: 974927 - DNA, 25 bp, Mus musculus
tttggcatggcgattgttacctctc

SEQ ID NO: 974928 - DNA, 25 bp, Mus musculus
tttggcatggcgcatttgttctgaa

SEQ ID NO: 974929 - DNA, 25 bp, Mus musculus
tttggcatggcggatttgttctgaa

SEQ ID NO: 974930 - DNA, 25 bp, Mus musculus
tttggcatggcgtttgttacctctc

SEQ ID NO: 974931 - DNA, 25 bp, Mus musculus
tttggcatgggtactgctggctcac

SEQ ID NO: 974932 - DNA, 25 bp, Mus musculus
tttggcatgggttctgctggctcac

SEQ ID NO: 974933 - DNA, 25 bp, Mus musculus
tttggcattattcttgagtgggcac

SEQ ID NO: 974934 - DNA, 25 bp, Mus musculus
tttggcattattgttgagtgggcac

SEQ ID NO: 974935 - DNA, 25 bp, Mus musculus
tttggcattcaaatctgtccccagt

SEQ ID NO: 974936 - DNA, 25 bp, Mus musculus
tttggcattcaattctgtccccagt

SEQ ID NO: 974937 - DNA, 25 bp, Mus musculus
tttggcattgccactcgtgtaggag

SEQ ID NO: 974938 - DNA, 25 bp, Mus musculus
tttggcattgcctctcgtgtaggag

SEQ ID NO: 974939 - DNA, 25 bp, Mus musculus
tttggcatttacattcggcttactg

SEQ ID NO: 974940 - DNA, 25 bp, Mus musculus
tttggcatttactttcggcttactg

SEQ ID NO: 974941 - DNA, 25 bp, Mus musculus
tttggcatttggaggctatttttct

SEQ ID NO: 974942 - DNA, 25 bp, Mus musculus
tttggcatttggtggctatttttct

SEQ ID NO: 974943 - DNA, 25 bp, Mus musculus
tttggccaaccgccctgaaaggaat

SEQ ID NO: 974944 - DNA, 25 bp, Mus musculus
tttggccaaccggcctgaaaggaat

SEQ ID NO: 974945 - DNA, 25 bp, Mus musculus
tttggccaactgcttagaagcccaa

SEQ ID NO: 974946 - DNA, 25 bp, Mus musculus
tttggccaactggttagaagcccaa

SEQ ID NO: 974947 - DNA, 25 bp, Mus musculus
tttggccacatccacttgtactgtt

SEQ ID NO: 974948 - DNA, 25 bp, Mus musculus
tttggccacatcgacttgtactgtt

SEQ ID NO: 974949 - DNA, 25 bp, Mus musculus
tttggccacggcctggtcatcaggc

SEQ ID NO: 974950 - DNA, 25 bp, Mus musculus
tttggccacggcgtggtcatcaggc

SEQ ID NO: 974951 - DNA, 25 bp, Mus musculus
tttggccacgtgaacaatcctgtac

SEQ ID NO: 974952 - DNA, 25 bp, Mus musculus
tttggccacgtgtacaatcctgtac

SEQ ID NO: 974953 - DNA, 25 bp, Mus musculus
tttggccactacagagaccttcaaa

SEQ ID NO: 974954 - DNA, 25 bp, Mus musculus
tttggccactactgagaccttcaaa

SEQ ID NO: 974955 - DNA, 25 bp, Mus musculus
tttggccagaacatacagctttaat

SEQ ID NO: 974956 - DNA, 25 bp, Mus musculus
tttggccagaacttacagctttaat

SEQ ID NO: 974957 - DNA, 25 bp, Mus musculus
tttggccagaccacataagattgtc

SEQ ID NO: 974958 - DNA, 25 bp, Mus musculus
tttggccagacctcataagattgtc

SEQ ID NO: 974959 - DNA, 25 bp, Mus musculus
tttggccaggcaccgatttacccgt

SEQ ID NO: 974960 - DNA, 25 bp, Mus musculus
tttggccaggcagcgatttacccgt

SEQ ID NO: 974961 - DNA, 25 bp, Mus musculus
tttggccagtggatcttttgacaag

SEQ ID NO: 974962 - DNA, 25 bp, Mus musculus
tttggccagtggttcttttgacaag

SEQ ID NO: 974963 - DNA, 25 bp, Mus musculus
tttggccagtgtctctcaggattta

SEQ ID NO: 974964 - DNA, 25 bp, Mus musculus
tttggccagtgtgtctcaggattta

SEQ ID NO: 974965 - DNA, 25 bp, Mus musculus
tttggccatcagactgtaattgcta

SEQ ID NO: 974966 - DNA, 25 bp, Mus musculus
tttggccatcagtctgtaattgcta

SEQ ID NO: 974967 - DNA, 25 bp, Mus musculus
tttggccatcataatttcaccgttg

SEQ ID NO: 974968 - DNA, 25 bp, Mus musculus
tttggccatcattatttcaccgttg

SEQ ID NO: 974969 - DNA, 25 bp, Mus musculus
tttggccatggcaatgcccgcctca

SEQ ID NO: 974970 - DNA, 25 bp, Mus musculus
tttggccatggctatgcccgcctca

SEQ ID NO: 974971 - DNA, 25 bp, Mus musculus
tttggccattgacctccagggagca

SEQ ID NO: 974972 - DNA, 25 bp, Mus musculus
tttggccattgagctccagggagca

SEQ ID NO: 974973 - DNA, 25 bp, Mus musculus
tttggccatttgattacatgttcaa

SEQ ID NO: 974974 - DNA, 25 bp, Mus musculus
tttggccatttgtttacatgttcaa

SEQ ID NO: 974975 - DNA, 25 bp, Mus musculus
tttggcccaaaacccctgagtgaca

SEQ ID NO: 974976 - DNA, 25 bp, Mus musculus
tttggcccaaaagccctgagtgaca

SEQ ID NO: 974977 - DNA, 25 bp, Mus musculus
tttggcccaggcatcttcttgaggc

SEQ ID NO: 974978 - DNA, 25 bp, Mus musculus
tttggcccaggcttcttcttgaggc

SEQ ID NO: 974979 - DNA, 25 bp, Mus musculus
tttggcccatacataaggaggtttg

SEQ ID NO: 974980 - DNA, 25 bp, Mus musculus
tttggcccatacttaaggaggtttg

SEQ ID NO: 974981 - DNA, 25 bp, Mus musculus
tttggccccactatagcagtatgca

SEQ ID NO: 974982 - DNA, 25 bp, Mus musculus
tttggccccactttagcagtatgca

SEQ ID NO: 974983 - DNA, 25 bp, Mus musculus
tttggccccattccaagtttaaatg

SEQ ID NO: 974984 - DNA, 25 bp, Mus musculus
tttggccccattgcaagtttaaatg

SEQ ID NO: 974985 - DNA, 25 bp, Mus musculus
tttggccccgagagtgaactttctt

SEQ ID NO: 974986 - DNA, 25 bp, Mus musculus
tttggccccgagtgtgaactttctt

SEQ ID NO: 974987 - DNA, 25 bp, Mus musculus
tttggcccctgcacatatgtagtag

SEQ ID NO: 974988 - DNA, 25 bp, Mus musculus
tttggcccctgctcatatgtagtag

SEQ ID NO: 974989 - DNA, 25 bp, Mus musculus
tttggccctagtattagaccttgat

SEQ ID NO: 974990 - DNA, 25 bp, Mus musculus
tttggccctagttttagaccttgat

SEQ ID NO: 974991 - DNA, 25 bp, Mus musculus
tttggccctggtacaaccgcttcag

SEQ ID NO: 974992 - DNA, 25 bp, Mus musculus
tttggccctggttcaaccgcttcag

SEQ ID NO: 974993 - DNA, 25 bp, Mus musculus
tttggccctgtaagaggtatgcata

SEQ ID NO: 974994 - DNA, 25 bp, Mus musculus
tttggccctgtatgaggtatgcata

SEQ ID NO: 974995 - DNA, 25 bp, Mus musculus
tttggcccttgtcctagtattattc

SEQ ID NO: 974996 - DNA, 25 bp, Mus musculus
tttggcccttgtgctagtattattc

SEQ ID NO: 974997 - DNA, 25 bp, Mus musculus
tttggccgaggcacaatacagcact

SEQ ID NO: 974998 - DNA, 25 bp, Mus musculus
tttggccgaggctcaatacagcact

SEQ ID NO: 974999 - DNA, 25 bp, Mus musculus
tttggccggacactcagcatctcgc

SEQ ID NO: 975000 - DNA, 25 bp, Mus musculus
tttggccggacagtcagcatctcgc

SEQ ID NO: 975001 - DNA, 25 bp, Mus musculus
tttggcctacaaacgcatctggagc

SEQ ID NO: 975002 - DNA, 25 bp, Mus musculus
tttggcctacaatcgcatctggagc

SEQ ID NO: 975003 - DNA, 25 bp, Mus musculus
tttggcctagagacttccatagtag

SEQ ID NO: 975004 - DNA, 25 bp, Mus musculus
tttggcctagagtcttccatagtag

SEQ ID NO: 975005 - DNA, 25 bp, Mus musculus
tttggcctattactgtggacacttg

SEQ ID NO: 975006 - DNA, 25 bp, Mus musculus
tttggcctattagtgtggacacttg

SEQ ID NO: 975007 - DNA, 25 bp, Mus musculus
tttggcctcaagctggaccggatcg

SEQ ID NO: 975008 - DNA, 25 bp, Mus musculus
tttggcctcaaggtggaccggatcg

SEQ ID NO: 975009 - DNA, 25 bp, Mus musculus
tttggcctcagtcattccttagaga

SEQ ID NO: 975010 - DNA, 25 bp, Mus musculus
tttggcctcagtgattccttagaga

SEQ ID NO: 975011 - DNA, 25 bp, Mus musculus
tttggcctccttaagagcaatagca

SEQ ID NO: 975012 - DNA, 25 bp, Mus musculus
tttggcctcctttagagcaatagca

SEQ ID NO: 975013 - DNA, 25 bp, Mus musculus
tttggcctctagacacagatctgtg

SEQ ID NO: 975014 - DNA, 25 bp, Mus musculus
tttggcctctagtcacagatctgtg

SEQ ID NO: 975015 - DNA, 25 bp, Mus musculus
tttggcctctgaacttttttcctag

SEQ ID NO: 975016 - DNA, 25 bp, Mus musculus
tttggcctctgactcagggcaggtt

SEQ ID NO: 975017 - DNA, 25 bp, Mus musculus
tttggcctctgagtcagggcaggtt

SEQ ID NO: 975018 - DNA, 25 bp, Mus musculus
tttggcctctgatcttttttcctag

SEQ ID NO: 975019 - DNA, 25 bp, Mus musculus
tttggcctctttataatgcacgtga

SEQ ID NO: 975020 - DNA, 25 bp, Mus musculus
tttggcctctttttaatgcacgtga

SEQ ID NO: 975021 - DNA, 25 bp, Mus musculus
tttggcctgcggcagattgctaaac

SEQ ID NO: 975022 - DNA, 25 bp, Mus musculus
tttggcctgcgggagattgctaaac

SEQ ID NO: 975023 - DNA, 25 bp, Mus musculus
tttggcctggctcgagatgtgcaca

SEQ ID NO: 975024 - DNA, 25 bp, Mus musculus
tttggcctggctggagatgtgcaca

SEQ ID NO: 975025 - DNA, 25 bp, Mus musculus
tttggcctggtgactgtacacttta

SEQ ID NO: 975026 - DNA, 25 bp, Mus musculus
tttggcctggtgtctgtacacttta

SEQ ID NO: 975027 - DNA, 25 bp, Mus musculus
tttggcctggttcagccgggtagtt

SEQ ID NO: 975028 - DNA, 25 bp, Mus musculus
tttggcctggttgagccgggtagtt

SEQ ID NO: 975029 - DNA, 25 bp, Mus musculus
tttggccttagccagcattagcatt

SEQ ID NO: 975030 - DNA, 25 bp, Mus musculus
tttggccttagcgagcattagcatt

SEQ ID NO: 975031 - DNA, 25 bp, Mus musculus
tttggccttgacaattattcttcat

SEQ ID NO: 975032 - DNA, 25 bp, Mus musculus
tttggccttgactattattcttcat

SEQ ID NO: 975033 - DNA, 25 bp, Mus musculus
tttggccttgggagccttctgggtc

SEQ ID NO: 975034 - DNA, 25 bp, Mus musculus
tttggccttgggtgccttctgggtc

SEQ ID NO: 975035 - DNA, 25 bp, Mus musculus
tttggcctttagaaaactgagtctt

SEQ ID NO: 975036 - DNA, 25 bp, Mus musculus
tttggcctttagtaaactgagtctt

SEQ ID NO: 975037 - DNA, 25 bp, Mus musculus
tttggccttttcacttcgtgtcttt

SEQ ID NO: 975038 - DNA, 25 bp, Mus musculus
tttggccttttctcttcgtgtcttt

SEQ ID NO: 975039 - DNA, 25 bp, Mus musculus
tttggccttttgagcaggttgtcct

SEQ ID NO: 975040 - DNA, 25 bp, Mus musculus
tttggccttttgcttagttagctcc

SEQ ID NO: 975041 - DNA, 25 bp, Mus musculus
tttggccttttggttagttagctcc

SEQ ID NO: 975042 - DNA, 25 bp, Mus musculus
tttggccttttgtgcaggttgtcct

SEQ ID NO: 975043 - DNA, 25 bp, Mus musculus
tttggcgaaagtccctgcagttgca

SEQ ID NO: 975044 - DNA, 25 bp, Mus musculus
tttggcgaaagtgcctgcagttgca

SEQ ID NO: 975045 - DNA, 25 bp, Mus musculus
tttggcgaacttaccatgtgagact

SEQ ID NO: 975046 - DNA, 25 bp, Mus musculus
tttggcgaactttccatgtgagact

SEQ ID NO: 975047 - DNA, 25 bp, Mus musculus
tttggcgactttcttgacgacatag

SEQ ID NO: 975048 - DNA, 25 bp, Mus musculus
tttggcgactttgttgacgacatag

SEQ ID NO: 975049 - DNA, 25 bp, Mus musculus
tttggcgagagcaccaccgagagtg

SEQ ID NO: 975050 - DNA, 25 bp, Mus musculus
tttggcgagagctccaccgagagtg

SEQ ID NO: 975051 - DNA, 25 bp, Mus musculus
tttggcgagcgaccctcatttttgc

SEQ ID NO: 975052 - DNA, 25 bp, Mus musculus
tttggcgagcgagcctcatttttgc

SEQ ID NO: 975053 - DNA, 25 bp, Mus musculus
tttggcgagctcagcgcaggcgcac

SEQ ID NO: 975054 - DNA, 25 bp, Mus musculus
tttggcgagctctgcgcaggcgcac

SEQ ID NO: 975055 - DNA, 25 bp, Mus musculus
tttggcgaggaactcgcccctcgga

SEQ ID NO: 975056 - DNA, 25 bp, Mus musculus
tttggcgaggaagtcgcccctcgga

SEQ ID NO: 975057 - DNA, 25 bp, Mus musculus
tttggcgataatatgtgaagtgact

SEQ ID NO: 975058 - DNA, 25 bp, Mus musculus
tttggcgataatcggagtctctcct

SEQ ID NO: 975059 - DNA, 25 bp, Mus musculus
tttggcgataatgggagtctctcct

SEQ ID NO: 975060 - DNA, 25 bp, Mus musculus
tttggcgataatttgtgaagtgact

SEQ ID NO: 975061 - DNA, 25 bp, Mus musculus
tttggcgatcacaggaagtgccctg

SEQ ID NO: 975062 - DNA, 25 bp, Mus musculus
tttggcgatcactggaagtgccctg

SEQ ID NO: 975063 - DNA, 25 bp, Mus musculus
tttggcgatgtgacaaggatccttt

SEQ ID NO: 975064 - DNA, 25 bp, Mus musculus
tttggcgatgtgtcaaggatccttt

SEQ ID NO: 975065 - DNA, 25 bp, Mus musculus
tttggcgccttcctgggttttcatg

SEQ ID NO: 975066 - DNA, 25 bp, Mus musculus
tttggcgccttcgtgggttttcatg

SEQ ID NO: 975067 - DNA, 25 bp, Mus musculus
tttggcggctacaagcattatctgt

SEQ ID NO: 975068 - DNA, 25 bp, Mus musculus
tttggcggctactagcattatctgt

SEQ ID NO: 975069 - DNA, 25 bp, Mus musculus
tttggcgtctccagagctgtccagg

SEQ ID NO: 975070 - DNA, 25 bp, Mus musculus
tttggcgtctcctgagctgtccagg

SEQ ID NO: 975071 - DNA, 25 bp, Mus musculus
tttggcgttcaacagcttcacccag

SEQ ID NO: 975072 - DNA, 25 bp, Mus musculus
tttggcgttcaagagcttcacccag

SEQ ID NO: 975073 - DNA, 25 bp, Mus musculus
tttggctaaactccactgtgtaagt

SEQ ID NO: 975074 - DNA, 25 bp, Mus musculus
tttggctaaactgcactgtgtaagt

SEQ ID NO: 975075 - DNA, 25 bp, Mus musculus
tttggctaaagtcagggagccctct

SEQ ID NO: 975076 - DNA, 25 bp, Mus musculus
tttggctaaagtgagggagccctct

SEQ ID NO: 975077 - DNA, 25 bp, Mus musculus
tttggctaagggaaatgatggatct

SEQ ID NO: 975078 - DNA, 25 bp, Mus musculus
tttggctaagggtaatgatggatct

SEQ ID NO: 975079 - DNA, 25 bp, Mus musculus
tttggctaccagatcggtaacataa

SEQ ID NO: 975080 - DNA, 25 bp, Mus musculus
tttggctaccagttcggtaacataa

SEQ ID NO: 975081 - DNA, 25 bp, Mus musculus
tttggctaccgtccgccttccagag

SEQ ID NO: 975082 - DNA, 25 bp, Mus musculus
tttggctaccgtgcgccttccagag

SEQ ID NO: 975083 - DNA, 25 bp, Mus musculus
tttggctacgtccttcctgatatta

SEQ ID NO: 975084 - DNA, 25 bp, Mus musculus
tttggctacgtcgttcctgatatta

SEQ ID NO: 975085 - DNA, 25 bp, Mus musculus
tttggctactacaaaagacatcata

SEQ ID NO: 975086 - DNA, 25 bp, Mus musculus
tttggctactactaaagacatcata

SEQ ID NO: 975087 - DNA, 25 bp, Mus musculus
tttggctactccaggacagtggctg

SEQ ID NO: 975088 - DNA, 25 bp, Mus musculus
tttggctactcctggacagtggctg

SEQ ID NO: 975089 - DNA, 25 bp, Mus musculus
tttggctatcaaacacgggcatcat

SEQ ID NO: 975090 - DNA, 25 bp, Mus musculus
tttggctatcaatcacgggcatcat

SEQ ID NO: 975091 - DNA, 25 bp, Mus musculus
tttggctatgggatgacaaccccat

SEQ ID NO: 975092 - DNA, 25 bp, Mus musculus
tttggctatgggttgacaaccccat

SEQ ID NO: 975093 - DNA, 25 bp, Mus musculus
tttggctcattcaatgacatgtaca

SEQ ID NO: 975094 - DNA, 25 bp, Mus musculus
tttggctcattctatgacatgtaca

SEQ ID NO: 975095 - DNA, 25 bp, Mus musculus
tttggctcatttaatcctgggatcg

SEQ ID NO: 975096 - DNA, 25 bp, Mus musculus
tttggctcattttatcctgggatcg

SEQ ID NO: 975097 - DNA, 25 bp, Mus musculus
tttggctccattcctgtggtagaag

SEQ ID NO: 975098 - DNA, 25 bp, Mus musculus
tttggctccattgctgtggtagaag

SEQ ID NO: 975099 - DNA, 25 bp, Mus musculus
tttggctcccagaagctacatggta

SEQ ID NO: 975100 - DNA, 25 bp, Mus musculus
tttggctcccagtagctacatggta

SEQ ID NO: 975101 - DNA, 25 bp, Mus musculus
tttggctcctccagttggctgactc

SEQ ID NO: 975102 - DNA, 25 bp, Mus musculus
tttggctcctcctgttggctgactc

SEQ ID NO: 975103 - DNA, 25 bp, Mus musculus
tttggctcctttcctccttgttttc

SEQ ID NO: 975104 - DNA, 25 bp, Mus musculus
tttggctcctttctgaaatcagtca

SEQ ID NO: 975105 - DNA, 25 bp, Mus musculus
tttggctcctttgctccttgttttc

SEQ ID NO: 975106 - DNA, 25 bp, Mus musculus
tttggctcctttgtgaaatcagtca

SEQ ID NO: 975107 - DNA, 25 bp, Mus musculus
tttggctcgggaatctcagacgcat

SEQ ID NO: 975108 - DNA, 25 bp, Mus musculus
tttggctcgggattctcagacgcat

SEQ ID NO: 975109 - DNA, 25 bp, Mus musculus
tttggctctactaggttttgtgtta

SEQ ID NO: 975110 - DNA, 25 bp, Mus musculus
tttggctctacttggttttgtgtta

SEQ ID NO: 975111 - DNA, 25 bp, Mus musculus
tttggctctcaccttttaactgcag

SEQ ID NO: 975112 - DNA, 25 bp, Mus musculus
tttggctctcacgttttaactgcag

SEQ ID NO: 975113 - DNA, 25 bp, Mus musculus
tttggctctgttaggctgtagtgct

SEQ ID NO: 975114 - DNA, 25 bp, Mus musculus
tttggctctgtttggctgtagtgct

SEQ ID NO: 975115 - DNA, 25 bp, Mus musculus
tttggctgctgtaacaaagacagat

SEQ ID NO: 975116 - DNA, 25 bp, Mus musculus
tttggctgctgttacaaagacagat

SEQ ID NO: 975117 - DNA, 25 bp, Mus musculus
tttggctggtgtccagagactcaat

SEQ ID NO: 975118 - DNA, 25 bp, Mus musculus
tttggctggtgtgcagagactcaat

SEQ ID NO: 975119 - DNA, 25 bp, Mus musculus
tttggctgtggcagtccagcgttga

SEQ ID NO: 975120 - DNA, 25 bp, Mus musculus
tttggctgtggctgtccagcgttga

SEQ ID NO: 975121 - DNA, 25 bp, Mus musculus
tttggctgttccacatcccgtacat

SEQ ID NO: 975122 - DNA, 25 bp, Mus musculus
tttggctgttcctcatcccgtacat

SEQ ID NO: 975123 - DNA, 25 bp, Mus musculus
tttggctgttgaatcagcatgaagt

SEQ ID NO: 975124 - DNA, 25 bp, Mus musculus
tttggctgttgaatcctctcctgac

SEQ ID NO: 975125 - DNA, 25 bp, Mus musculus
tttggctgttgattcagcatgaagt

SEQ ID NO: 975126 - DNA, 25 bp, Mus musculus
tttggctgttgattcctctcctgac

SEQ ID NO: 975127 - DNA, 25 bp, Mus musculus
tttggcttaatcctgtttcatactg

SEQ ID NO: 975128 - DNA, 25 bp, Mus musculus
tttggcttaatcgtgtttcatactg

SEQ ID NO: 975129 - DNA, 25 bp, Mus musculus
tttggcttagaaccagcctgcttat

SEQ ID NO: 975130 - DNA, 25 bp, Mus musculus
tttggcttagaagcagcctgcttat

SEQ ID NO: 975131 - DNA, 25 bp, Mus musculus
tttggcttaggcacttccggtacct

SEQ ID NO: 975132 - DNA, 25 bp, Mus musculus
tttggcttaggctcttccggtacct

SEQ ID NO: 975133 - DNA, 25 bp, Mus musculus
tttggcttatagatggtttttagtg

SEQ ID NO: 975134 - DNA, 25 bp, Mus musculus
tttggcttatagttggtttttagtg

SEQ ID NO: 975135 - DNA, 25 bp, Mus musculus
tttggcttcctcaattttcggtttg

SEQ ID NO: 975136 - DNA, 25 bp, Mus musculus
tttggcttcctctattttcggtttg

SEQ ID NO: 975137 - DNA, 25 bp, Mus musculus
tttggcttcggaatatcaccacctt

SEQ ID NO: 975138 - DNA, 25 bp, Mus musculus
tttggcttcggattatcaccacctt

SEQ ID NO: 975139 - DNA, 25 bp, Mus musculus
tttggcttctccacattcacatgta

SEQ ID NO: 975140 - DNA, 25 bp, Mus musculus
tttggcttctcctcattcacatgta

SEQ ID NO: 975141 - DNA, 25 bp, Mus musculus
tttggcttctggaccttcctgttct

SEQ ID NO: 975142 - DNA, 25 bp, Mus musculus
tttggcttctggtccttcctgttct

SEQ ID NO: 975143 - DNA, 25 bp, Mus musculus
tttggcttcttgaagtgactctcgt

SEQ ID NO: 975144 - DNA, 25 bp, Mus musculus
tttggcttcttgtagtgactctcgt

SEQ ID NO: 975145 - DNA, 25 bp, Mus musculus
tttggcttgattcaggcaaccagga

SEQ ID NO: 975146 - DNA, 25 bp, Mus musculus
tttggcttgattgaggcaaccagga

SEQ ID NO: 975147 - DNA, 25 bp, Mus musculus
tttggcttgcctagatagctgacct

SEQ ID NO: 975148 - DNA, 25 bp, Mus musculus
tttggcttgccttgatagctgacct

SEQ ID NO: 975149 - DNA, 25 bp, Mus musculus
tttggcttggatcgattaactcaga

SEQ ID NO: 975150 - DNA, 25 bp, Mus musculus
tttggcttggatggattaactcaga

SEQ ID NO: 975151 - DNA, 25 bp, Mus musculus
tttggcttggcaacctcagcagagt

SEQ ID NO: 975152 - DNA, 25 bp, Mus musculus
tttggcttggcatcctcagcagagt

SEQ ID NO: 975153 - DNA, 25 bp, Mus musculus
tttggcttggcccttcctggtgctc

SEQ ID NO: 975154 - DNA, 25 bp, Mus musculus
tttggcttggccgttcctggtgctc

SEQ ID NO: 975155 - DNA, 25 bp, Mus musculus
tttggcttggctactgtgataaccc

SEQ ID NO: 975156 - DNA, 25 bp, Mus musculus
tttggcttggcttctgtgataaccc

SEQ ID NO: 975157 - DNA, 25 bp, Mus musculus
tttggcttgggcatgtcattctaaa

SEQ ID NO: 975158 - DNA, 25 bp, Mus musculus
tttggcttgggcttgtcattctaaa

SEQ ID NO: 975159 - DNA, 25 bp, Mus musculus
tttggcttgggtctggcctaccgca

SEQ ID NO: 975160 - DNA, 25 bp, Mus musculus
tttggcttgggtgtggcctaccgca

SEQ ID NO: 975161 - DNA, 25 bp, Mus musculus
tttggcttgttcagcatcatgtact

SEQ ID NO: 975162 - DNA, 25 bp, Mus musculus
tttggcttgttctgcatcatgtact

SEQ ID NO: 975163 - DNA, 25 bp, Mus musculus
tttggctttatgaccagggttgccc

SEQ ID NO: 975164 - DNA, 25 bp, Mus musculus
tttggctttatgtccagggttgccc

SEQ ID NO: 975165 - DNA, 25 bp, Mus musculus
tttggctttcacagtgaacccttga

SEQ ID NO: 975166 - DNA, 25 bp, Mus musculus
tttggctttcactgtgaacccttga

SEQ ID NO: 975167 - DNA, 25 bp, Mus musculus
tttggctttctgctgatataacctg

SEQ ID NO: 975168 - DNA, 25 bp, Mus musculus
tttggctttctggtgatataacctg

SEQ ID NO: 975169 - DNA, 25 bp, Mus musculus
tttggctttgaccactaactccttg

SEQ ID NO: 975170 - DNA, 25 bp, Mus musculus
tttggctttgacgactaactccttg

SEQ ID NO: 975171 - DNA, 25 bp, Mus musculus
tttggcttttcactgtctttacaac

SEQ ID NO: 975172 - DNA, 25 bp, Mus musculus
tttggcttttcagtgtctttacaac

SEQ ID NO: 975173 - DNA, 25 bp, Mus musculus
tttggctttttcaccaccgtgttca

SEQ ID NO: 975174 - DNA, 25 bp, Mus musculus
tttggctttttctccaccgtgttca

SEQ ID NO: 975175 - DNA, 25 bp, Mus musculus
tttgggaaacgaatgcactaacttt

SEQ ID NO: 975176 - DNA, 25 bp, Mus musculus
tttgggaaacgattgcactaacttt

SEQ ID NO: 975177 - DNA, 25 bp, Mus musculus
tttgggaacccgaatgtcacaggta

SEQ ID NO: 975178 - DNA, 25 bp, Mus musculus
tttgggaacccgtatgtcacaggta

SEQ ID NO: 975179 - DNA, 25 bp, Mus musculus
tttgggaacctaacacagacaacac

SEQ ID NO: 975180 - DNA, 25 bp, Mus musculus
tttgggaacctatcacagacaacac

SEQ ID NO: 975181 - DNA, 25 bp, Mus musculus
tttgggaatttcacacactgtactc

SEQ ID NO: 975182 - DNA, 25 bp, Mus musculus
tttgggaatttctcacactgtactc

SEQ ID NO: 975183 - DNA, 25 bp, Mus musculus
tttgggacagacactcaggccagca

SEQ ID NO: 975184 - DNA, 25 bp, Mus musculus
tttgggacagactctcaggccagca

SEQ ID NO: 975185 - DNA, 25 bp, Mus musculus
tttgggacagccagttgttctagcc

SEQ ID NO: 975186 - DNA, 25 bp, Mus musculus
tttgggacagcctgttgttctagcc

SEQ ID NO: 975187 - DNA, 25 bp, Mus musculus
tttgggacccaaccatcccgggcgg

SEQ ID NO: 975188 - DNA, 25 bp, Mus musculus
tttgggacccaagcatcccgggcgg

SEQ ID NO: 975189 - DNA, 25 bp, Mus musculus
tttgggaccccgagcagtggattcg

SEQ ID NO: 975190 - DNA, 25 bp, Mus musculus
tttgggaccccgtgcagtggattcg

SEQ ID NO: 975191 - DNA, 25 bp, Mus musculus
tttgggaccctactttagagctaag

SEQ ID NO: 975192 - DNA, 25 bp, Mus musculus
tttgggaccctagtttagagctaag

SEQ ID NO: 975193 - DNA, 25 bp, Mus musculus
tttgggacctacaatactcctcagg

SEQ ID NO: 975194 - DNA, 25 bp, Mus musculus
tttgggacctactatactcctcagg

SEQ ID NO: 975195 - DNA, 25 bp, Mus musculus
tttgggacctccagccaccagtcag

SEQ ID NO: 975196 - DNA, 25 bp, Mus musculus
tttgggacctcctgccaccagtcag

SEQ ID NO: 975197 - DNA, 25 bp, Mus musculus
tttgggacctgcagaaatctttttt

SEQ ID NO: 975198 - DNA, 25 bp, Mus musculus
tttgggacctgctgaaatctttttt

SEQ ID NO: 975199 - DNA, 25 bp, Mus musculus
tttgggacttataagaacactgtat

SEQ ID NO: 975200 - DNA, 25 bp, Mus musculus
tttgggacttattagaacactgtat

SEQ ID NO: 975201 - DNA, 25 bp, Mus musculus
tttgggagaacaacacaactctgat

SEQ ID NO: 975202 - DNA, 25 bp, Mus musculus
tttgggagaacatcacaactctgat

SEQ ID NO: 975203 - DNA, 25 bp, Mus musculus
tttgggagaagtccctggcttctgc

SEQ ID NO: 975204 - DNA, 25 bp, Mus musculus
tttgggagaagtgcctggcttctgc

SEQ ID NO: 975205 - DNA, 25 bp, Mus musculus
tttgggagagcacatcttttcccaa

SEQ ID NO: 975206 - DNA, 25 bp, Mus musculus
tttgggagagcagatcttttcccaa

SEQ ID NO: 975207 - DNA, 25 bp, Mus musculus
tttgggagatacagatgggacctta

SEQ ID NO: 975208 - DNA, 25 bp, Mus musculus
tttgggagatactgatgggacctta

SEQ ID NO: 975209 - DNA, 25 bp, Mus musculus
tttgggagcaccctgctttagaggc

SEQ ID NO: 975210 - DNA, 25 bp, Mus musculus
tttgggagcaccgtgctttagaggc

SEQ ID NO: 975211 - DNA, 25 bp, Mus musculus
tttgggagcctccatgtacagtcct

SEQ ID NO: 975212 - DNA, 25 bp, Mus musculus
tttgggagcctcgatgtacagtcct

SEQ ID NO: 975213 - DNA, 25 bp, Mus musculus
tttgggagcctgatgaccttgaaga

SEQ ID NO: 975214 - DNA, 25 bp, Mus musculus
tttgggagcctgttgaccttgaaga

SEQ ID NO: 975215 - DNA, 25 bp, Mus musculus
tttgggaggctccaaggcagtcatt

SEQ ID NO: 975216 - DNA, 25 bp, Mus musculus
tttgggaggctcgaaggcagtcatt

SEQ ID NO: 975217 - DNA, 25 bp, Mus musculus
tttgggagtcaacgccctcttctcg

SEQ ID NO: 975218 - DNA, 25 bp, Mus musculus
tttgggagtcaaggccctcttctcg

SEQ ID NO: 975219 - DNA, 25 bp, Mus musculus
tttgggagtgaccttgttgagaatc

SEQ ID NO: 975220 - DNA, 25 bp, Mus musculus
tttgggagtgacgttgttgagaatc

SEQ ID NO: 975221 - DNA, 25 bp, Mus musculus
tttgggagtttcaagccacttccag

SEQ ID NO: 975222 - DNA, 25 bp, Mus musculus
tttgggagtttctagccacttccag

SEQ ID NO: 975223 - DNA, 25 bp, Mus musculus
tttgggagtttgaagcaatgtctgt

SEQ ID NO: 975224 - DNA, 25 bp, Mus musculus
tttgggagtttgtagcaatgtctgt

SEQ ID NO: 975225 - DNA, 25 bp, Mus musculus
tttgggatacggactcactctagcc

SEQ ID NO: 975226 - DNA, 25 bp, Mus musculus
tttgggatacggtctcactctagcc

SEQ ID NO: 975227 - DNA, 25 bp, Mus musculus
tttgggatactgacatcgcttgcca

SEQ ID NO: 975228 - DNA, 25 bp, Mus musculus
tttgggatactgtcatcgcttgcca

SEQ ID NO: 975229 - DNA, 25 bp, Mus musculus
tttgggatcattcacaggattcctc

SEQ ID NO: 975230 - DNA, 25 bp, Mus musculus
tttgggatcattgacaggattcctc

SEQ ID NO: 975231 - DNA, 25 bp, Mus musculus
tttgggatccctcatgatgaaaaag

SEQ ID NO: 975232 - DNA, 25 bp, Mus musculus
tttgggatccctgatgatgaaaaag

SEQ ID NO: 975233 - DNA, 25 bp, Mus musculus
tttgggatccggaatgtcacacaca

SEQ ID NO: 975234 - DNA, 25 bp, Mus musculus
tttgggatccggtatgtcacacaca

SEQ ID NO: 975235 - DNA, 25 bp, Mus musculus
tttgggatgacaacgctggcaaagg

SEQ ID NO: 975236 - DNA, 25 bp, Mus musculus
tttgggatgacatcgctggcaaagg

SEQ ID NO: 975237 - DNA, 25 bp, Mus musculus
tttgggatgaccagtgttggatcac

SEQ ID NO: 975238 - DNA, 25 bp, Mus musculus
tttgggatgacctgtgttggatcac

SEQ ID NO: 975239 - DNA, 25 bp, Mus musculus
tttgggatggcaaggctgaaagcac

SEQ ID NO: 975240 - DNA, 25 bp, Mus musculus
tttgggatggcatggctgaaagcac

SEQ ID NO: 975241 - DNA, 25 bp, Mus musculus
tttgggattccacctgaagatcagc

SEQ ID NO: 975242 - DNA, 25 bp, Mus musculus
tttgggattccagctgaagatcagc

SEQ ID NO: 975243 - DNA, 25 bp, Mus musculus
tttgggattcttcagagtttataca

SEQ ID NO: 975244 - DNA, 25 bp, Mus musculus
tttgggattcttcttcaactctagc

SEQ ID NO: 975245 - DNA, 25 bp, Mus musculus
tttgggattcttgagagtttataca

SEQ ID NO: 975246 - DNA, 25 bp, Mus musculus
tttgggattcttgttcaactctagc

SEQ ID NO: 975247 - DNA, 25 bp, Mus musculus
tttgggatttctagagagacctgag

SEQ ID NO: 975248 - DNA, 25 bp, Mus musculus
tttgggatttcttgagagacctgag

SEQ ID NO: 975249 - DNA, 25 bp, Mus musculus
tttgggcaaacgacccatctccata

SEQ ID NO: 975250 - DNA, 25 bp, Mus musculus
tttgggcaaacgtcccatctccata

SEQ ID NO: 975251 - DNA, 25 bp, Mus musculus
tttgggcaacttaggtgctttgaag

SEQ ID NO: 975252 - DNA, 25 bp, Mus musculus
tttgggcaactttggtgctttgaag

SEQ ID NO: 975253 - DNA, 25 bp, Mus musculus
tttgggcaatcacactcacccaatg

SEQ ID NO: 975254 - DNA, 25 bp, Mus musculus
tttgggcaatcagactcacccaatg

SEQ ID NO: 975255 - DNA, 25 bp, Mus musculus
tttgggcaatctcggcactttttaa

SEQ ID NO: 975256 - DNA, 25 bp, Mus musculus
tttgggcaatctgggcactttttaa

SEQ ID NO: 975257 - DNA, 25 bp, Mus musculus
tttgggcacaggatgttgtactact

SEQ ID NO: 975258 - DNA, 25 bp, Mus musculus
tttgggcacaggttgttgtactact

SEQ ID NO: 975259 - DNA, 25 bp, Mus musculus
tttgggcacataagtccccatccag

SEQ ID NO: 975260 - DNA, 25 bp, Mus musculus
tttgggcacatatgtccccatccag

SEQ ID NO: 975261 - DNA, 25 bp, Mus musculus
tttgggcacatgaaacaacacacac

SEQ ID NO: 975262 - DNA, 25 bp, Mus musculus
tttgggcacatgtaacaacacacac

SEQ ID NO: 975263 - DNA, 25 bp, Mus musculus
tttgggcagctcagtcctgaaaaga

SEQ ID NO: 975264 - DNA, 25 bp, Mus musculus
tttgggcagctctgtcctgaaaaga

SEQ ID NO: 975265 - DNA, 25 bp, Mus musculus
tttgggcaggacaacaggtgagaac

SEQ ID NO: 975266 - DNA, 25 bp, Mus musculus
tttgggcaggactacaggtgagaac

SEQ ID NO: 975267 - DNA, 25 bp, Mus musculus
tttgggcagggcaagcttcaccatg

SEQ ID NO: 975268 - DNA, 25 bp, Mus musculus
tttgggcagggctagcttcaccatg

SEQ ID NO: 975269 - DNA, 25 bp, Mus musculus
tttgggcatcaaatattcgtttaca

SEQ ID NO: 975270 - DNA, 25 bp, Mus musculus
tttgggcatcaattattcgtttaca

SEQ ID NO: 975271 - DNA, 25 bp, Mus musculus
tttgggcatcagagacttatggtct

SEQ ID NO: 975272 - DNA, 25 bp, Mus musculus
tttgggcatcagtgacttatggtct

SEQ ID NO: 975273 - DNA, 25 bp, Mus musculus
tttgggcatcttagcattttatcag

SEQ ID NO: 975274 - DNA, 25 bp, Mus musculus
tttgggcatctttgcattttatcag

SEQ ID NO: 975275 - DNA, 25 bp, Mus musculus
tttgggccacatctaccttataata

SEQ ID NO: 975276 - DNA, 25 bp, Mus musculus
tttgggccacatgtaccttataata

SEQ ID NO: 975277 - DNA, 25 bp, Mus musculus
tttgggccagaaatgttctccggta

SEQ ID NO: 975278 - DNA, 25 bp, Mus musculus
tttgggccagaacgcagcttctctt

SEQ ID NO: 975279 - DNA, 25 bp, Mus musculus
tttgggccagaaggcagcttctctt

SEQ ID NO: 975280 - DNA, 25 bp, Mus musculus
tttgggccagaattgttctccggta

SEQ ID NO: 975281 - DNA, 25 bp, Mus musculus
tttgggccaggaacagactattgtc

SEQ ID NO: 975282 - DNA, 25 bp, Mus musculus
tttgggccaggatcagactattgtc

SEQ ID NO: 975283 - DNA, 25 bp, Mus musculus
tttgggcccactctgggagcagcaa

SEQ ID NO: 975284 - DNA, 25 bp, Mus musculus
tttgggcccactgtgggagcagcaa

SEQ ID NO: 975285 - DNA, 25 bp, Mus musculus
tttgggcccataaaacccagacacg

SEQ ID NO: 975286 - DNA, 25 bp, Mus musculus
tttgggcccatataacccagacacg

SEQ ID NO: 975287 - DNA, 25 bp, Mus musculus
tttgggcccgcacgattaaagttct

SEQ ID NO: 975288 - DNA, 25 bp, Mus musculus
tttgggcccgcaggattaaagttct

SEQ ID NO: 975289 - DNA, 25 bp, Mus musculus
tttgggccctgacaagtgaaatcac

SEQ ID NO: 975290 - DNA, 25 bp, Mus musculus
tttgggccctgagaagtgaaatcac

SEQ ID NO: 975291 - DNA, 25 bp, Mus musculus
tttgggccgatcacataaatgtacc

SEQ ID NO: 975292 - DNA, 25 bp, Mus musculus
tttgggccgatctcataaatgtacc

SEQ ID NO: 975293 - DNA, 25 bp, Mus musculus
tttgggccgatgaagggaggaaact

SEQ ID NO: 975294 - DNA, 25 bp, Mus musculus
tttgggccgatgtagggaggaaact

SEQ ID NO: 975295 - DNA, 25 bp, Mus musculus
tttgggccggtgaagcttgacctga

SEQ ID NO: 975296 - DNA, 25 bp, Mus musculus
tttgggccggtgtagcttgacctga

SEQ ID NO: 975297 - DNA, 25 bp, Mus musculus
tttgggccgttaactcacggcgaac

SEQ ID NO: 975298 - DNA, 25 bp, Mus musculus
tttgggccgttatctcacggcgaac

SEQ ID NO: 975299 - DNA, 25 bp, Mus musculus
tttgggcctggaagagagcgctcac

SEQ ID NO: 975300 - DNA, 25 bp, Mus musculus
tttgggcctggatgagagcgctcac

SEQ ID NO: 975301 - DNA, 25 bp, Mus musculus
tttgggcctggcacaatgatacggg

SEQ ID NO: 975302 - DNA, 25 bp, Mus musculus
tttgggcctggccaacctgattgtt

SEQ ID NO: 975303 - DNA, 25 bp, Mus musculus
tttgggcctggcgaacctgattgtt

SEQ ID NO: 975304 - DNA, 25 bp, Mus musculus
tttgggcctggctcaatgatacggg

SEQ ID NO: 975305 - DNA, 25 bp, Mus musculus
tttgggccttcaaagggtccatttc

SEQ ID NO: 975306 - DNA, 25 bp, Mus musculus
tttgggccttcatagggtccatttc

SEQ ID NO: 975307 - DNA, 25 bp, Mus musculus
tttgggcgcttcatgcaggatgcaa

SEQ ID NO: 975308 - DNA, 25 bp, Mus musculus
tttgggcgcttcttgcaggatgcaa

SEQ ID NO: 975309 - DNA, 25 bp, Mus musculus
tttgggctaatacaaagctcaaggt

SEQ ID NO: 975310 - DNA, 25 bp, Mus musculus
tttgggctaatagaaagctcaaggt

SEQ ID NO: 975311 - DNA, 25 bp, Mus musculus
tttgggctacatcttcatccgtaaa

SEQ ID NO: 975312 - DNA, 25 bp, Mus musculus
tttgggctacatgttcatccgtaaa

SEQ ID NO: 975313 - DNA, 25 bp, Mus musculus
tttgggctaccaataaacttcttct

SEQ ID NO: 975314 - DNA, 25 bp, Mus musculus
tttgggctaccattaaacttcttct

SEQ ID NO: 975315 - DNA, 25 bp, Mus musculus
tttgggctatatatacatgctacta

SEQ ID NO: 975316 - DNA, 25 bp, Mus musculus
tttgggctatatttacatgctacta

SEQ ID NO: 975317 - DNA, 25 bp, Mus musculus
tttgggctcagtcgctgtgacagaa

SEQ ID NO: 975318 - DNA, 25 bp, Mus musculus
tttgggctcagtggctgtgacagaa

SEQ ID NO: 975319 - DNA, 25 bp, Mus musculus
tttgggctcccaccgatatgggttg

SEQ ID NO: 975320 - DNA, 25 bp, Mus musculus
tttgggctcccagcgatatgggttg

SEQ ID NO: 975321 - DNA, 25 bp, Mus musculus
tttgggctcgctccgaagcagataa

SEQ ID NO: 975322 - DNA, 25 bp, Mus musculus
tttgggctcgctgcgaagcagataa

SEQ ID NO: 975323 - DNA, 25 bp, Mus musculus
tttgggctgatcaagaacttgctct

SEQ ID NO: 975324 - DNA, 25 bp, Mus musculus
tttgggctgatctagaacttgctct

SEQ ID NO: 975325 - DNA, 25 bp, Mus musculus
tttgggctgattccatagtccagac

SEQ ID NO: 975326 - DNA, 25 bp, Mus musculus
tttgggctgattgcatagtccagac

SEQ ID NO: 975327 - DNA, 25 bp, Mus musculus
tttgggctgccaatcaacataactg

SEQ ID NO: 975328 - DNA, 25 bp, Mus musculus
tttgggctgccattcaacataactg

SEQ ID NO: 975329 - DNA, 25 bp, Mus musculus
tttgggctggatcggtctgttcccc

SEQ ID NO: 975330 - DNA, 25 bp, Mus musculus
tttgggctggatgggtctgttcccc

SEQ ID NO: 975331 - DNA, 25 bp, Mus musculus
tttgggctggcacatagatgattct

SEQ ID NO: 975332 - DNA, 25 bp, Mus musculus
tttgggctggcagatagatgattct

SEQ ID NO: 975333 - DNA, 25 bp, Mus musculus
tttgggcttacacggacgctcagtc

SEQ ID NO: 975334 - DNA, 25 bp, Mus musculus
tttgggcttacagggacgctcagtc

SEQ ID NO: 975335 - DNA, 25 bp, Mus musculus
tttgggcttccaacagtggctgcat

SEQ ID NO: 975336 - DNA, 25 bp, Mus musculus
tttgggcttccatcagtggctgcat

SEQ ID NO: 975337 - DNA, 25 bp, Mus musculus
tttgggctttgtctgtcggaatgat

SEQ ID NO: 975338 - DNA, 25 bp, Mus musculus
tttgggctttgtgtgtcggaatgat

SEQ ID NO: 975339 - DNA, 25 bp, Mus musculus
tttgggcttttgcagatgccagagc

SEQ ID NO: 975340 - DNA, 25 bp, Mus musculus
tttgggcttttggagatgccagagc

SEQ ID NO: 975341 - DNA, 25 bp, Mus musculus
tttgggtaagtgacctcaacggcct

SEQ ID NO: 975342 - DNA, 25 bp, Mus musculus
tttgggtaagtgtcctcaacggcct

SEQ ID NO: 975343 - DNA, 25 bp, Mus musculus
tttgggtacctaccggagctgaaga

SEQ ID NO: 975344 - DNA, 25 bp, Mus musculus
tttgggtacctagcggagctgaaga

SEQ ID NO: 975345 - DNA, 25 bp, Mus musculus
tttgggtactagctgactgccactc

SEQ ID NO: 975346 - DNA, 25 bp, Mus musculus
tttgggtactaggtgactgccactc

SEQ ID NO: 975347 - DNA, 25 bp, Mus musculus
tttgggtatggcactgactattaca

SEQ ID NO: 975348 - DNA, 25 bp, Mus musculus
tttgggtatggctctgactattaca

SEQ ID NO: 975349 - DNA, 25 bp, Mus musculus
tttgggtcaactccactccagcagg

SEQ ID NO: 975350 - DNA, 25 bp, Mus musculus
tttgggtcaactgcactccagcagg

SEQ ID NO: 975351 - DNA, 25 bp, Mus musculus
tttgggtcaagtcccattgaagcat

SEQ ID NO: 975352 - DNA, 25 bp, Mus musculus
tttgggtcaagtgccattgaagcat

SEQ ID NO: 975353 - DNA, 25 bp, Mus musculus
tttgggtcatgaacttctgctgtcc

SEQ ID NO: 975354 - DNA, 25 bp, Mus musculus
tttgggtcatgatcttctgctgtcc

SEQ ID NO: 975355 - DNA, 25 bp, Mus musculus
tttgggtctgaaagaaccgttctca

SEQ ID NO: 975356 - DNA, 25 bp, Mus musculus
tttgggtctgaatgaaccgttctca

SEQ ID NO: 975357 - DNA, 25 bp, Mus musculus
tttgggtgatttagggcatcccttt

SEQ ID NO: 975358 - DNA, 25 bp, Mus musculus
tttgggtgattttgggcatcccttt

SEQ ID NO: 975359 - DNA, 25 bp, Mus musculus
tttgggtgcaatagttcttgagaca

SEQ ID NO: 975360 - DNA, 25 bp, Mus musculus
tttgggtgcaattgttcttgagaca

SEQ ID NO: 975361 - DNA, 25 bp, Mus musculus
tttgggtgcttaccagccatttgtt

SEQ ID NO: 975362 - DNA, 25 bp, Mus musculus
tttgggtgcttagcagccatttgtt

SEQ ID NO: 975363 - DNA, 25 bp, Mus musculus
tttgggtggtgacatttgctgcttt

SEQ ID NO: 975364 - DNA, 25 bp, Mus musculus
tttgggtggtgagatttgctgcttt

SEQ ID NO: 975365 - DNA, 25 bp, Mus musculus
tttgggtggtttccttcagtccctc

SEQ ID NO: 975366 - DNA, 25 bp, Mus musculus
tttgggtggtttgcttcagtccctc

SEQ ID NO: 975367 - DNA, 25 bp, Mus musculus
tttgggtgtaaaccgtttggcctag

SEQ ID NO: 975368 - DNA, 25 bp, Mus musculus
tttgggtgtaaagcgtttggcctag

SEQ ID NO: 975369 - DNA, 25 bp, Mus musculus
tttgggtgtcttaagtttctcctca

SEQ ID NO: 975370 - DNA, 25 bp, Mus musculus
tttgggtgtctttagtttctcctca

SEQ ID NO: 975371 - DNA, 25 bp, Mus musculus
tttgggttatgactgcaccccagaa

SEQ ID NO: 975372 - DNA, 25 bp, Mus musculus
tttgggttatgagtgcaccccagaa

SEQ ID NO: 975373 - DNA, 25 bp, Mus musculus
tttgggttatttactgctatgcatc

SEQ ID NO: 975374 - DNA, 25 bp, Mus musculus
tttgggttattttctgctatgcatc

SEQ ID NO: 975375 - DNA, 25 bp, Mus musculus
tttgggttcaatctcaacacagcat

SEQ ID NO: 975376 - DNA, 25 bp, Mus musculus
tttgggttcaatgtcaacacagcat

SEQ ID NO: 975377 - DNA, 25 bp, Mus musculus
tttgggttcaccacagcgaagtctc

SEQ ID NO: 975378 - DNA, 25 bp, Mus musculus
tttgggttcacctcagcgaagtctc

SEQ ID NO: 975379 - DNA, 25 bp, Mus musculus
tttgggttctccctggcgcagagca

SEQ ID NO: 975380 - DNA, 25 bp, Mus musculus
tttgggttctccgtggcgcagagca

SEQ ID NO: 975381 - DNA, 25 bp, Mus musculus
tttgggttgctcagctacttgaagc

SEQ ID NO: 975382 - DNA, 25 bp, Mus musculus
tttgggttgctctgctacttgaagc

SEQ ID NO: 975383 - DNA, 25 bp, Mus musculus
tttgggttgttgattgtttgaggca

SEQ ID NO: 975384 - DNA, 25 bp, Mus musculus
tttgggttgttgtttgtttgaggca

SEQ ID NO: 975385 - DNA, 25 bp, Mus musculus
tttgggttgtttacgtgtaatatag

SEQ ID NO: 975386 - DNA, 25 bp, Mus musculus
tttgggttgttttcgtgtaatatag

SEQ ID NO: 975387 - DNA, 25 bp, Mus musculus
tttgggtttctcatattaaagctgc

SEQ ID NO: 975388 - DNA, 25 bp, Mus musculus
tttgggtttctcttattaaagctgc

SEQ ID NO: 975389 - DNA, 25 bp, Mus musculus
tttgggtttggcactttgggtgtct

SEQ ID NO: 975390 - DNA, 25 bp, Mus musculus
tttgggtttggctctttgggtgtct

SEQ ID NO: 975391 - DNA, 25 bp, Mus musculus
tttgggtttttaacagccgtgtctg

SEQ ID NO: 975392 - DNA, 25 bp, Mus musculus
tttgggtttttatcagccgtgtctg

SEQ ID NO: 975393 - DNA, 25 bp, Mus musculus
tttggtaacaccatctgcttctttg

SEQ ID NO: 975394 - DNA, 25 bp, Mus musculus
tttggtaacaccttctgcttctttg

SEQ ID NO: 975395 - DNA, 25 bp, Mus musculus
tttggtaagcttctccttagccttt

SEQ ID NO: 975396 - DNA, 25 bp, Mus musculus
tttggtaagcttgtccttagccttt

SEQ ID NO: 975397 - DNA, 25 bp, Mus musculus
tttggtaagtgcaccacctgctgag

SEQ ID NO: 975398 - DNA, 25 bp, Mus musculus
tttggtaagtgctccacctgctgag

SEQ ID NO: 975399 - DNA, 25 bp, Mus musculus
tttggtaatcatcggtggcacatct

SEQ ID NO: 975400 - DNA, 25 bp, Mus musculus
tttggtaatcatgggtggcacatct

SEQ ID NO: 975401 - DNA, 25 bp, Mus musculus
tttggtaatgttatagactgccttt

SEQ ID NO: 975402 - DNA, 25 bp, Mus musculus
tttggtaatgttttagactgccttt

SEQ ID NO: 975403 - DNA, 25 bp, Mus musculus
tttggtaattacagtcttttctgtt

SEQ ID NO: 975404 - DNA, 25 bp, Mus musculus
tttggtaattactgtcttttctgtt

SEQ ID NO: 975405 - DNA, 25 bp, Mus musculus
tttggtacaccaaatgcttgaaatc

SEQ ID NO: 975406 - DNA, 25 bp, Mus musculus
tttggtacaccatatgcttgaaatc

SEQ ID NO: 975407 - DNA, 25 bp, Mus musculus
tttggtacagagactcagtacctat

SEQ ID NO: 975408 - DNA, 25 bp, Mus musculus
tttggtacagagtctcagtacctat

SEQ ID NO: 975409 - DNA, 25 bp, Mus musculus
tttggtacatatacctgtatgcagg

SEQ ID NO: 975410 - DNA, 25 bp, Mus musculus
tttggtacatattcctgtatgcagg

SEQ ID NO: 975411 - DNA, 25 bp, Mus musculus
tttggtaccagccattggcgataat

SEQ ID NO: 975412 - DNA, 25 bp, Mus musculus
tttggtaccagcgattggcgataat

SEQ ID NO: 975413 - DNA, 25 bp, Mus musculus
tttggtacctcgcaaacctttgcag

SEQ ID NO: 975414 - DNA, 25 bp, Mus musculus
tttggtacctcggaaacctttgcag

SEQ ID NO: 975415 - DNA, 25 bp, Mus musculus
tttggtacggtaagaacacaccttc

SEQ ID NO: 975416 - DNA, 25 bp, Mus musculus
tttggtacggtatgaacacaccttc

SEQ ID NO: 975417 - DNA, 25 bp, Mus musculus
tttggtactacaccattccaccatc

SEQ ID NO: 975418 - DNA, 25 bp, Mus musculus
tttggtactacagcattccaccatc

SEQ ID NO: 975419 - DNA, 25 bp, Mus musculus
tttggtagaataaattctcctttgc

SEQ ID NO: 975420 - DNA, 25 bp, Mus musculus
tttggtagaatatattctcctttgc

SEQ ID NO: 975421 - DNA, 25 bp, Mus musculus
tttggtagaatcatcacgggagact

SEQ ID NO: 975422 - DNA, 25 bp, Mus musculus
tttggtagaatcttcacgggagact

SEQ ID NO: 975423 - DNA, 25 bp, Mus musculus
tttggtagagagactaggctgccta

SEQ ID NO: 975424 - DNA, 25 bp, Mus musculus
tttggtagagagtctaggctgccta

SEQ ID NO: 975425 - DNA, 25 bp, Mus musculus
tttggtaggttccatcccttagcca

SEQ ID NO: 975426 - DNA, 25 bp, Mus musculus
tttggtaggttcgatcccttagcca

SEQ ID NO: 975427 - DNA, 25 bp, Mus musculus
tttggtagttttcccagtggactgt

SEQ ID NO: 975428 - DNA, 25 bp, Mus musculus
tttggtagttttgccagtggactgt

SEQ ID NO: 975429 - DNA, 25 bp, Mus musculus
tttggtataactctggatgaaacac

SEQ ID NO: 975430 - DNA, 25 bp, Mus musculus
tttggtataactgtggatgaaacac

SEQ ID NO: 975431 - DNA, 25 bp, Mus musculus
tttggtatatgtccaggagtgatat

SEQ ID NO: 975432 - DNA, 25 bp, Mus musculus
tttggtatatgtgcaggagtgatat

SEQ ID NO: 975433 - DNA, 25 bp, Mus musculus
tttggtatcgatatgagacctggat

SEQ ID NO: 975434 - DNA, 25 bp, Mus musculus
tttggtatcgatttgagacctggat

SEQ ID NO: 975435 - DNA, 25 bp, Mus musculus
tttggtatctgactctcaaactgaa

SEQ ID NO: 975436 - DNA, 25 bp, Mus musculus
tttggtatctgagtctcaaactgaa

SEQ ID NO: 975437 - DNA, 25 bp, Mus musculus
tttggtattcatcacaatccatcag

SEQ ID NO: 975438 - DNA, 25 bp, Mus musculus
tttggtattcatgacaatccatcag

SEQ ID NO: 975439 - DNA, 25 bp, Mus musculus
tttggtattgtgaactcgtccctca

SEQ ID NO: 975440 - DNA, 25 bp, Mus musculus
tttggtattgtgtactcgtccctca

SEQ ID NO: 975441 - DNA, 25 bp, Mus musculus
tttggtatttctaaccttcctctct

SEQ ID NO: 975442 - DNA, 25 bp, Mus musculus
tttggtatttcttaccttcctctct

SEQ ID NO: 975443 - DNA, 25 bp, Mus musculus
tttggtatttggcttctatctctgt

SEQ ID NO: 975444 - DNA, 25 bp, Mus musculus
tttggtatttgggttctatctctgt

SEQ ID NO: 975445 - DNA, 25 bp, Mus musculus
tttggtatttttcccctcaacttat

SEQ ID NO: 975446 - DNA, 25 bp, Mus musculus
tttggtatttttctgggcatagagg

SEQ ID NO: 975447 - DNA, 25 bp, Mus musculus
tttggtatttttgccctcaacttat

SEQ ID NO: 975448 - DNA, 25 bp, Mus musculus
tttggtatttttgtgggcatagagg

SEQ ID NO: 975449 - DNA, 25 bp, Mus musculus
tttggtcaactaactaatgcctatt

SEQ ID NO: 975450 - DNA, 25 bp, Mus musculus
tttggtcaactatctaatgcctatt

SEQ ID NO: 975451 - DNA, 25 bp, Mus musculus
tttggtcaaggccagaaagcaccca

SEQ ID NO: 975452 - DNA, 25 bp, Mus musculus
tttggtcaaggcgagaaagcaccca

SEQ ID NO: 975453 - DNA, 25 bp, Mus musculus
tttggtcacaatcaatctcaacaag

SEQ ID NO: 975454 - DNA, 25 bp, Mus musculus
tttggtcacaatgaatctcaacaag

SEQ ID NO: 975455 - DNA, 25 bp, Mus musculus
tttggtcacagcatacatgtctata

SEQ ID NO: 975456 - DNA, 25 bp, Mus musculus
tttggtcacagcttacatgtctata

SEQ ID NO: 975457 - DNA, 25 bp, Mus musculus
tttggtcacccacatcaaggtgctt

SEQ ID NO: 975458 - DNA, 25 bp, Mus musculus
tttggtcacccagatcaaggtgctt

SEQ ID NO: 975459 - DNA, 25 bp, Mus musculus
tttggtcaccctactgtaacttcaa

SEQ ID NO: 975460 - DNA, 25 bp, Mus musculus
tttggtcacccttctgtaacttcaa

SEQ ID NO: 975461 - DNA, 25 bp, Mus musculus
tttggtcagaaacctgcccttctac

SEQ ID NO: 975462 - DNA, 25 bp, Mus musculus
tttggtcagaaagctgcccttctac

SEQ ID NO: 975463 - DNA, 25 bp, Mus musculus
tttggtcaggtaatcgtcatccgac

SEQ ID NO: 975464 - DNA, 25 bp, Mus musculus
tttggtcaggtattcgtcatccgac

SEQ ID NO: 975465 - DNA, 25 bp, Mus musculus
tttggtcatcacatctacaaaagca

SEQ ID NO: 975466 - DNA, 25 bp, Mus musculus
tttggtcatcacttctacaaaagca

SEQ ID NO: 975467 - DNA, 25 bp, Mus musculus
tttggtcattttccacttgaagagg

SEQ ID NO: 975468 - DNA, 25 bp, Mus musculus
tttggtcattttgcacttgaagagg

SEQ ID NO: 975469 - DNA, 25 bp, Mus musculus
tttggtccacttattgatggtgcta

SEQ ID NO: 975470 - DNA, 25 bp, Mus musculus
tttggtccactttttgatggtgcta

SEQ ID NO: 975471 - DNA, 25 bp, Mus musculus
tttggtccagttacctgtgtttagg

SEQ ID NO: 975472 - DNA, 25 bp, Mus musculus
tttggtccagtttcctgtgtttagg

SEQ ID NO: 975473 - DNA, 25 bp, Mus musculus
tttggtccccagaactgagaaatcc

SEQ ID NO: 975474 - DNA, 25 bp, Mus musculus
tttggtccccagtactgagaaatcc

SEQ ID NO: 975475 - DNA, 25 bp, Mus musculus
tttggtccctgtcttctgaaataat

SEQ ID NO: 975476 - DNA, 25 bp, Mus musculus
tttggtccctgtgttctgaaataat

SEQ ID NO: 975477 - DNA, 25 bp, Mus musculus
tttggtccggcaacttcaacaacag

SEQ ID NO: 975478 - DNA, 25 bp, Mus musculus
tttggtccggcatcttcaacaacag

SEQ ID NO: 975479 - DNA, 25 bp, Mus musculus
tttggtccgtacaaggttgctgcac

SEQ ID NO: 975480 - DNA, 25 bp, Mus musculus
tttggtccgtactaggttgctgcac

SEQ ID NO: 975481 - DNA, 25 bp, Mus musculus
tttggtcggcgcctctgtcaatcag

SEQ ID NO: 975482 - DNA, 25 bp, Mus musculus
tttggtcggcgcgtctgtcaatcag

SEQ ID NO: 975483 - DNA, 25 bp, Mus musculus
tttggtcgtattaacttcctctttg

SEQ ID NO: 975484 - DNA, 25 bp, Mus musculus
tttggtcgtatttacttcctctttg

SEQ ID NO: 975485 - DNA, 25 bp, Mus musculus
tttggtctaagaattgcctctaaag

SEQ ID NO: 975486 - DNA, 25 bp, Mus musculus
tttggtctaagatttgcctctaaag

SEQ ID NO: 975487 - DNA, 25 bp, Mus musculus
tttggtctaatccttcctgtaggaa

SEQ ID NO: 975488 - DNA, 25 bp, Mus musculus
tttggtctaatcgttcctgtaggaa

SEQ ID NO: 975489 - DNA, 25 bp, Mus musculus
tttggtctacagacccacaaaatca

SEQ ID NO: 975490 - DNA, 25 bp, Mus musculus
tttggtctacagtcccacaaaatca

SEQ ID NO: 975491 - DNA, 25 bp, Mus musculus
tttggtctcattcacggtcgcctca

SEQ ID NO: 975492 - DNA, 25 bp, Mus musculus
tttggtctcattgacggtcgcctca

SEQ ID NO: 975493 - DNA, 25 bp, Mus musculus
tttggtctccaaaatatgaacacgg

SEQ ID NO: 975494 - DNA, 25 bp, Mus musculus
tttggtctccaatatatgaacacgg

SEQ ID NO: 975495 - DNA, 25 bp, Mus musculus
tttggtctcgttctttggccagata

SEQ ID NO: 975496 - DNA, 25 bp, Mus musculus
tttggtctcgttgtttggccagata

SEQ ID NO: 975497 - DNA, 25 bp, Mus musculus
tttggtctctacctactgtttcaga

SEQ ID NO: 975498 - DNA, 25 bp, Mus musculus
tttggtctctacgtactgtttcaga

SEQ ID NO: 975499 - DNA, 25 bp, Mus musculus
tttggtctctttcctcctatacttc

SEQ ID NO: 975500 - DNA, 25 bp, Mus musculus
tttggtctctttgctcctatacttc

SEQ ID NO: 975501 - DNA, 25 bp, Mus musculus
tttggtctgcgtcctccttggtagt

SEQ ID NO: 975502 - DNA, 25 bp, Mus musculus
tttggtctgcgtgctccttggtagt

SEQ ID NO: 975503 - DNA, 25 bp, Mus musculus
tttggtctgctcaggctcataaaag

SEQ ID NO: 975504 - DNA, 25 bp, Mus musculus
tttggtctgctctggctcataaaag

SEQ ID NO: 975505 - DNA, 25 bp, Mus musculus
tttggtctggacaatgggctcatca

SEQ ID NO: 975506 - DNA, 25 bp, Mus musculus
tttggtctggactatgggctcatca

SEQ ID NO: 975507 - DNA, 25 bp, Mus musculus
tttggtctggttaagacctggtctc

SEQ ID NO: 975508 - DNA, 25 bp, Mus musculus
tttggtctggtttagacctggtctc

SEQ ID NO: 975509 - DNA, 25 bp, Mus musculus
tttggtcttaccattgccattacaa

SEQ ID NO: 975510 - DNA, 25 bp, Mus musculus
tttggtcttacctttgccattacaa

SEQ ID NO: 975511 - DNA, 25 bp, Mus musculus
tttggtcttgaaattcattctatac

SEQ ID NO: 975512 - DNA, 25 bp, Mus musculus
tttggtcttgaatttcattctatac

SEQ ID NO: 975513 - DNA, 25 bp, Mus musculus
tttggtcttgctatcctgttaatac

SEQ ID NO: 975514 - DNA, 25 bp, Mus musculus
tttggtcttgctttcctgttaatac

SEQ ID NO: 975515 - DNA, 25 bp, Mus musculus
tttggtgaaatcagacttcactcct

SEQ ID NO: 975516 - DNA, 25 bp, Mus musculus
tttggtgaaatctgacttcactcct

SEQ ID NO: 975517 - DNA, 25 bp, Mus musculus
tttggtgaacataaactctaccctg

SEQ ID NO: 975518 - DNA, 25 bp, Mus musculus
tttggtgaacattaactctaccctg

SEQ ID NO: 975519 - DNA, 25 bp, Mus musculus
tttggtgaagataccagttctgcaa

SEQ ID NO: 975520 - DNA, 25 bp, Mus musculus
tttggtgaagattccagttctgcaa

SEQ ID NO: 975521 - DNA, 25 bp, Mus musculus
tttggtgaaggcacaaagctgacag

SEQ ID NO: 975522 - DNA, 25 bp, Mus musculus
tttggtgaaggctcaaagctgacag

SEQ ID NO: 975523 - DNA, 25 bp, Mus musculus
tttggtgaatgtcactctgcggctt

SEQ ID NO: 975524 - DNA, 25 bp, Mus musculus
tttggtgaatgtgactctgcggctt

SEQ ID NO: 975525 - DNA, 25 bp, Mus musculus
tttggtgacattatctgtttcagat

SEQ ID NO: 975526 - DNA, 25 bp, Mus musculus
tttggtgacattttctgtttcagat

SEQ ID NO: 975527 - DNA, 25 bp, Mus musculus
tttggtgagaccaccacacctgcag

SEQ ID NO: 975528 - DNA, 25 bp, Mus musculus
tttggtgagacctccacacctgcag

SEQ ID NO: 975529 - DNA, 25 bp, Mus musculus
tttggtgagagccaggacctatcca

SEQ ID NO: 975530 - DNA, 25 bp, Mus musculus
tttggtgagagcgaggacctatcca

SEQ ID NO: 975531 - DNA, 25 bp, Mus musculus
tttggtgagccaaacatgcccttct

SEQ ID NO: 975532 - DNA, 25 bp, Mus musculus
tttggtgagccacctactgaggagc

SEQ ID NO: 975533 - DNA, 25 bp, Mus musculus
tttggtgagccagctactgaggagc

SEQ ID NO: 975534 - DNA, 25 bp, Mus musculus
tttggtgagccatacatgcccttct

SEQ ID NO: 975535 - DNA, 25 bp, Mus musculus
tttggtgagcttccattgggagaac

SEQ ID NO: 975536 - DNA, 25 bp, Mus musculus
tttggtgagcttgcattgggagaac

SEQ ID NO: 975537 - DNA, 25 bp, Mus musculus
tttggtgaggtgatctttctttgca

SEQ ID NO: 975538 - DNA, 25 bp, Mus musculus
tttggtgaggtgttctttctttgca

SEQ ID NO: 975539 - DNA, 25 bp, Mus musculus
tttggtgagtcacaccatccttggt

SEQ ID NO: 975540 - DNA, 25 bp, Mus musculus
tttggtgagtcactcatgacccacg

SEQ ID NO: 975541 - DNA, 25 bp, Mus musculus
tttggtgagtcagaccatccttggt

SEQ ID NO: 975542 - DNA, 25 bp, Mus musculus
tttggtgagtcagtcatgacccacg

SEQ ID NO: 975543 - DNA, 25 bp, Mus musculus
tttggtgagtccaccattggtggat

SEQ ID NO: 975544 - DNA, 25 bp, Mus musculus
tttggtgagtcctccattggtggat

SEQ ID NO: 975545 - DNA, 25 bp, Mus musculus
tttggtgagtggaccagagctctga

SEQ ID NO: 975546 - DNA, 25 bp, Mus musculus
tttggtgagtggtccagagctctga

SEQ ID NO: 975547 - DNA, 25 bp, Mus musculus
tttggtgatcgcctggcagtacatt

SEQ ID NO: 975548 - DNA, 25 bp, Mus musculus
tttggtgatcgcgtggcagtacatt

SEQ ID NO: 975549 - DNA, 25 bp, Mus musculus
tttggtgatcggctcacgtagccac

SEQ ID NO: 975550 - DNA, 25 bp, Mus musculus
tttggtgatcgggtcacgtagccac

SEQ ID NO: 975551 - DNA, 25 bp, Mus musculus
tttggtgattctagtccttagggtc

SEQ ID NO: 975552 - DNA, 25 bp, Mus musculus
tttggtgattcttgtccttagggtc

SEQ ID NO: 975553 - DNA, 25 bp, Mus musculus
tttggtgcacacacaatcattgtga

SEQ ID NO: 975554 - DNA, 25 bp, Mus musculus
tttggtgcacactcaatcattgtga

SEQ ID NO: 975555 - DNA, 25 bp, Mus musculus
tttggtgcagacagggacccatggc

SEQ ID NO: 975556 - DNA, 25 bp, Mus musculus
tttggtgcagactgggacccatggc

SEQ ID NO: 975557 - DNA, 25 bp, Mus musculus
tttggtgcatcaactggagccttca

SEQ ID NO: 975558 - DNA, 25 bp, Mus musculus
tttggtgcatcatctggagccttca

SEQ ID NO: 975559 - DNA, 25 bp, Mus musculus
tttggtgccattactttgcccaaga

SEQ ID NO: 975560 - DNA, 25 bp, Mus musculus
tttggtgccatttctttgcccaaga

SEQ ID NO: 975561 - DNA, 25 bp, Mus musculus
tttggtgcccacagtaagactcagg

SEQ ID NO: 975562 - DNA, 25 bp, Mus musculus
tttggtgcccactgtaagactcagg

SEQ ID NO: 975563 - DNA, 25 bp, Mus musculus
tttggtgccccacccctgaagcagg

SEQ ID NO: 975564 - DNA, 25 bp, Mus musculus
tttggtgccccagccctgaagcagg

SEQ ID NO: 975565 - DNA, 25 bp, Mus musculus
tttggtgccctcaggaagtacacag

SEQ ID NO: 975566 - DNA, 25 bp, Mus musculus
tttggtgccctctggaagtacacag

SEQ ID NO: 975567 - DNA, 25 bp, Mus musculus
tttggtgcctgcctgttgatatcct

SEQ ID NO: 975568 - DNA, 25 bp, Mus musculus
tttggtgcctgcgtgttgatatcct

SEQ ID NO: 975569 - DNA, 25 bp, Mus musculus
tttggtgctcggcagttcacagttt

SEQ ID NO: 975570 - DNA, 25 bp, Mus musculus
tttggtgctcgggagttcacagttt

SEQ ID NO: 975571 - DNA, 25 bp, Mus musculus
tttggtgctctgaaagttgtctgga

SEQ ID NO: 975572 - DNA, 25 bp, Mus musculus
tttggtgctctgactaaccttggat

SEQ ID NO: 975573 - DNA, 25 bp, Mus musculus
tttggtgctctgtaagttgtctgga

SEQ ID NO: 975574 - DNA, 25 bp, Mus musculus
tttggtgctctgtctaaccttggat

SEQ ID NO: 975575 - DNA, 25 bp, Mus musculus
tttggtgctgatcttgggctgttat

SEQ ID NO: 975576 - DNA, 25 bp, Mus musculus
tttggtgctgatgttgggctgttat

SEQ ID NO: 975577 - DNA, 25 bp, Mus musculus
tttggtgctttcaactcattgggaa

SEQ ID NO: 975578 - DNA, 25 bp, Mus musculus
tttggtgctttctactcattgggaa

SEQ ID NO: 975579 - DNA, 25 bp, Mus musculus
tttggtggaaggcacccattttcat

SEQ ID NO: 975580 - DNA, 25 bp, Mus musculus
tttggtggaagggacccattttcat

SEQ ID NO: 975581 - DNA, 25 bp, Mus musculus
tttggtggacacaggcattggcatg

SEQ ID NO: 975582 - DNA, 25 bp, Mus musculus
tttggtggacactggcattggcatg

SEQ ID NO: 975583 - DNA, 25 bp, Mus musculus
tttggtggacggcttacctctgaca

SEQ ID NO: 975584 - DNA, 25 bp, Mus musculus
tttggtggacgggttacctctgaca

SEQ ID NO: 975585 - DNA, 25 bp, Mus musculus
tttggtggcactaccgaagatcctt

SEQ ID NO: 975586 - DNA, 25 bp, Mus musculus
tttggtggcacttccgaagatcctt

SEQ ID NO: 975587 - DNA, 25 bp, Mus musculus
tttggtggcagcagtaatctaaatg

SEQ ID NO: 975588 - DNA, 25 bp, Mus musculus
tttggtggcagctgtaatctaaatg

SEQ ID NO: 975589 - DNA, 25 bp, Mus musculus
tttggtggccctagtgctcaacgta

SEQ ID NO: 975590 - DNA, 25 bp, Mus musculus
tttggtggcccttgtgctcaacgta

SEQ ID NO: 975591 - DNA, 25 bp, Mus musculus
tttggtggcttgaacccagcctgag

SEQ ID NO: 975592 - DNA, 25 bp, Mus musculus
tttggtggcttgtacccagcctgag

SEQ ID NO: 975593 - DNA, 25 bp, Mus musculus
tttggtgggtaaatgtactgcgaca

SEQ ID NO: 975594 - DNA, 25 bp, Mus musculus
tttggtgggtaattgtactgcgaca

SEQ ID NO: 975595 - DNA, 25 bp, Mus musculus
tttggtggtactaagccaactgaac

SEQ ID NO: 975596 - DNA, 25 bp, Mus musculus
tttggtggtacttagccaactgaac

SEQ ID NO: 975597 - DNA, 25 bp, Mus musculus
tttggtggtcctaccatagctagga

SEQ ID NO: 975598 - DNA, 25 bp, Mus musculus
tttggtggtccttccatagctagga

SEQ ID NO: 975599 - DNA, 25 bp, Mus musculus
tttggtggtcttcctattctttcca

SEQ ID NO: 975600 - DNA, 25 bp, Mus musculus
tttggtggtcttgctattctttcca

SEQ ID NO: 975601 - DNA, 25 bp, Mus musculus
tttggtggtttcaagagcttcagtc

SEQ ID NO: 975602 - DNA, 25 bp, Mus musculus
tttggtggtttctagagcttcagtc

SEQ ID NO: 975603 - DNA, 25 bp, Mus musculus
tttggtgtaacacataccgcattct

SEQ ID NO: 975604 - DNA, 25 bp, Mus musculus
tttggtgtaacagataccgcattct

SEQ ID NO: 975605 - DNA, 25 bp, Mus musculus
tttggtgtagtgcagtgtacgcaac

SEQ ID NO: 975606 - DNA, 25 bp, Mus musculus
tttggtgtagtggagtgtacgcaac

SEQ ID NO: 975607 - DNA, 25 bp, Mus musculus
tttggtgtattgctcctatgcctgt

SEQ ID NO: 975608 - DNA, 25 bp, Mus musculus
tttggtgtattggtcctatgcctgt

SEQ ID NO: 975609 - DNA, 25 bp, Mus musculus
tttggtgtcacacgcggcacgtttt

SEQ ID NO: 975610 - DNA, 25 bp, Mus musculus
tttggtgtcacaggcggcacgtttt

SEQ ID NO: 975611 - DNA, 25 bp, Mus musculus
tttggtgtccaacaaggaacttgtc

SEQ ID NO: 975612 - DNA, 25 bp, Mus musculus
tttggtgtccaagaaggaacttgtc

SEQ ID NO: 975613 - DNA, 25 bp, Mus musculus
tttggtgtccgtatgtattgaataa

SEQ ID NO: 975614 - DNA, 25 bp, Mus musculus
tttggtgtccgtttgtattgaataa

SEQ ID NO: 975615 - DNA, 25 bp, Mus musculus
tttggtgtcgccctgctatgcaaag

SEQ ID NO: 975616 - DNA, 25 bp, Mus musculus
tttggtgtcgccgtgctatgcaaag

SEQ ID NO: 975617 - DNA, 25 bp, Mus musculus
tttggtgtgcaaccaggcctttaac

SEQ ID NO: 975618 - DNA, 25 bp, Mus musculus
tttggtgtgcaagcaggcctttaac

SEQ ID NO: 975619 - DNA, 25 bp, Mus musculus
tttggtgtgtgtcaagattgtaata

SEQ ID NO: 975620 - DNA, 25 bp, Mus musculus
tttggtgtgtgtgaagattgtaata

SEQ ID NO: 975621 - DNA, 25 bp, Mus musculus
tttggtgtgttgcacttgaaagaga

SEQ ID NO: 975622 - DNA, 25 bp, Mus musculus
tttggtgtgttggacttgaaagaga

SEQ ID NO: 975623 - DNA, 25 bp, Mus musculus
tttggtgttaaaattagcttcctca

SEQ ID NO: 975624 - DNA, 25 bp, Mus musculus
tttggtgttaaatttagcttcctca

SEQ ID NO: 975625 - DNA, 25 bp, Mus musculus
tttggtgttgccagtggtcttggtc

SEQ ID NO: 975626 - DNA, 25 bp, Mus musculus
tttggtgttgcctgtggtcttggtc

SEQ ID NO: 975627 - DNA, 25 bp, Mus musculus
tttggtgtttttacctgagtctgtt

SEQ ID NO: 975628 - DNA, 25 bp, Mus musculus
tttggtgttttttcctgagtctgtt

SEQ ID NO: 975629 - DNA, 25 bp, Mus musculus
tttggttaactgactggctctttat

SEQ ID NO: 975630 - DNA, 25 bp, Mus musculus
tttggttaactgtctggctctttat

SEQ ID NO: 975631 - DNA, 25 bp, Mus musculus
tttggttacaccaggaattctcagc

SEQ ID NO: 975632 - DNA, 25 bp, Mus musculus
tttggttacacctggaattctcagc

SEQ ID NO: 975633 - DNA, 25 bp, Mus musculus
tttggttacatgacagatactggga

SEQ ID NO: 975634 - DNA, 25 bp, Mus musculus
tttggttacatgtcagatactggga

SEQ ID NO: 975635 - DNA, 25 bp, Mus musculus
tttggttacctcctttctgctataa

SEQ ID NO: 975636 - DNA, 25 bp, Mus musculus
tttggttacctcgtttctgctataa

SEQ ID NO: 975637 - DNA, 25 bp, Mus musculus
tttggttactgcacagctgaggagt

SEQ ID NO: 975638 - DNA, 25 bp, Mus musculus
tttggttactgctcagctgaggagt

SEQ ID NO: 975639 - DNA, 25 bp, Mus musculus
tttggttacttaacctacttcatag

SEQ ID NO: 975640 - DNA, 25 bp, Mus musculus
tttggttacttatcctacttcatag

SEQ ID NO: 975641 - DNA, 25 bp, Mus musculus
tttggttagcttcgtcactcactgt

SEQ ID NO: 975642 - DNA, 25 bp, Mus musculus
tttggttagcttggtcactcactgt

SEQ ID NO: 975643 - DNA, 25 bp, Mus musculus
tttggttattgtcgtctccttggtc

SEQ ID NO: 975644 - DNA, 25 bp, Mus musculus
tttggttattgtggtctccttggtc

SEQ ID NO: 975645 - DNA, 25 bp, Mus musculus
tttggttcaaacagagggtcctgca

SEQ ID NO: 975646 - DNA, 25 bp, Mus musculus
tttggttcaaactgagggtcctgca

SEQ ID NO: 975647 - DNA, 25 bp, Mus musculus
tttggttcacctatcttgtctttga

SEQ ID NO: 975648 - DNA, 25 bp, Mus musculus
tttggttcacctttcttgtctttga

SEQ ID NO: 975649 - DNA, 25 bp, Mus musculus
tttggttcacttcagcgctgggtaa

SEQ ID NO: 975650 - DNA, 25 bp, Mus musculus
tttggttcacttgagcgctgggtaa

SEQ ID NO: 975651 - DNA, 25 bp, Mus musculus
tttggttcccaaagctacgtcaagt

SEQ ID NO: 975652 - DNA, 25 bp, Mus musculus
tttggttcccaatgctacgtcaagt

SEQ ID NO: 975653 - DNA, 25 bp, Mus musculus
tttggttcccacagctacttggttc

SEQ ID NO: 975654 - DNA, 25 bp, Mus musculus
tttggttcccactgctacttggttc

SEQ ID NO: 975655 - DNA, 25 bp, Mus musculus
tttggttcccatactgccattccca

SEQ ID NO: 975656 - DNA, 25 bp, Mus musculus
tttggttcccattctgccattccca

SEQ ID NO: 975657 - DNA, 25 bp, Mus musculus
tttggttccccaacagtgttgctga

SEQ ID NO: 975658 - DNA, 25 bp, Mus musculus
tttggttccccaagaatgtctcttt

SEQ ID NO: 975659 - DNA, 25 bp, Mus musculus
tttggttccccatcagtgttgctga

SEQ ID NO: 975660 - DNA, 25 bp, Mus musculus
tttggttccccatgaatgtctcttt

SEQ ID NO: 975661 - DNA, 25 bp, Mus musculus
tttggttccctgataatgttctccc

SEQ ID NO: 975662 - DNA, 25 bp, Mus musculus
tttggttccctgttaatgttctccc

SEQ ID NO: 975663 - DNA, 25 bp, Mus musculus
tttggttcctctagtttccttggag

SEQ ID NO: 975664 - DNA, 25 bp, Mus musculus
tttggttcctcttgtttccttggag

SEQ ID NO: 975665 - DNA, 25 bp, Mus musculus
tttggttcgcacacgctgttcccta

SEQ ID NO: 975666 - DNA, 25 bp, Mus musculus
tttggttcgcactcgctgttcccta

SEQ ID NO: 975667 - DNA, 25 bp, Mus musculus
tttggttcgcataaagctaagtaag

SEQ ID NO: 975668 - DNA, 25 bp, Mus musculus
tttggttcgcattaagctaagtaag

SEQ ID NO: 975669 - DNA, 25 bp, Mus musculus
tttggttctcaactcccacatgatg

SEQ ID NO: 975670 - DNA, 25 bp, Mus musculus
tttggttctcaagtcccacatgatg

SEQ ID NO: 975671 - DNA, 25 bp, Mus musculus
tttggttctcatactcatttaggga

SEQ ID NO: 975672 - DNA, 25 bp, Mus musculus
tttggttctcatattgccgttccca

SEQ ID NO: 975673 - DNA, 25 bp, Mus musculus
tttggttctcattctcatttaggga

SEQ ID NO: 975674 - DNA, 25 bp, Mus musculus
tttggttctcattttgccgttccca

SEQ ID NO: 975675 - DNA, 25 bp, Mus musculus
tttggttctgatattcttctgtcga

SEQ ID NO: 975676 - DNA, 25 bp, Mus musculus
tttggttctgattttcttctgtcga

SEQ ID NO: 975677 - DNA, 25 bp, Mus musculus
tttggttctgtgacatttccacttg

SEQ ID NO: 975678 - DNA, 25 bp, Mus musculus
tttggttctgtgtcatttccacttg

SEQ ID NO: 975679 - DNA, 25 bp, Mus musculus
tttggttcttctcttgcacgagact

SEQ ID NO: 975680 - DNA, 25 bp, Mus musculus
tttggttcttctgttgcacgagact

SEQ ID NO: 975681 - DNA, 25 bp, Mus musculus
tttggttcttgaaagttggcctcag

SEQ ID NO: 975682 - DNA, 25 bp, Mus musculus
tttggttcttgatagttggcctcag

SEQ ID NO: 975683 - DNA, 25 bp, Mus musculus
tttggttctttgctgtttctattaa

SEQ ID NO: 975684 - DNA, 25 bp, Mus musculus
tttggttctttggtgtttctattaa

SEQ ID NO: 975685 - DNA, 25 bp, Mus musculus
tttggttgacctctctcaccatcag

SEQ ID NO: 975686 - DNA, 25 bp, Mus musculus
tttggttgacctgtctcaccatcag

SEQ ID NO: 975687 - DNA, 25 bp, Mus musculus
tttggttgctgaatctactttgtat

SEQ ID NO: 975688 - DNA, 25 bp, Mus musculus
tttggttgctgattctactttgtat

SEQ ID NO: 975689 - DNA, 25 bp, Mus musculus
tttggttggaagaaaatatctggcg

SEQ ID NO: 975690 - DNA, 25 bp, Mus musculus
tttggttggaagtaaatatctggcg

SEQ ID NO: 975691 - DNA, 25 bp, Mus musculus
tttggttgtaaaaaattccctgtgg

SEQ ID NO: 975692 - DNA, 25 bp, Mus musculus
tttggttgtaaataattccctgtgg

SEQ ID NO: 975693 - DNA, 25 bp, Mus musculus
tttggttgtcttcgaggatcagttc

SEQ ID NO: 975694 - DNA, 25 bp, Mus musculus
tttggttgtcttggaggatcagttc

SEQ ID NO: 975695 - DNA, 25 bp, Mus musculus
tttggttgtttcactggccaagtgt

SEQ ID NO: 975696 - DNA, 25 bp, Mus musculus
tttggttgtttctctggccaagtgt

SEQ ID NO: 975697 - DNA, 25 bp, Mus musculus
tttggtttactcatgctttgctatt

SEQ ID NO: 975698 - DNA, 25 bp, Mus musculus
tttggtttactcttgctttgctatt

SEQ ID NO: 975699 - DNA, 25 bp, Mus musculus
tttggtttagatcacccctcctggg

SEQ ID NO: 975700 - DNA, 25 bp, Mus musculus
tttggtttagatgacccctcctggg

SEQ ID NO: 975701 - DNA, 25 bp, Mus musculus
tttggtttatataagcagttttagc

SEQ ID NO: 975702 - DNA, 25 bp, Mus musculus
tttggtttatattagcagttttagc

SEQ ID NO: 975703 - DNA, 25 bp, Mus musculus
tttggtttcaacatgtagtcctgga

SEQ ID NO: 975704 - DNA, 25 bp, Mus musculus
tttggtttcaacttgtagtcctgga

SEQ ID NO: 975705 - DNA, 25 bp, Mus musculus
tttggtttcacaactgcatccatat

SEQ ID NO: 975706 - DNA, 25 bp, Mus musculus
tttggtttcacatctgcatccatat

SEQ ID NO: 975707 - DNA, 25 bp, Mus musculus
tttggtttccatcgtcacctggtaa

SEQ ID NO: 975708 - DNA, 25 bp, Mus musculus
tttggtttccatggtcacctggtaa

SEQ ID NO: 975709 - DNA, 25 bp, Mus musculus
tttggtttcccgatgagtgtacact

SEQ ID NO: 975710 - DNA, 25 bp, Mus musculus
tttggtttcccgttgagtgtacact

SEQ ID NO: 975711 - DNA, 25 bp, Mus musculus
tttggtttccgcattctcctcctgg

SEQ ID NO: 975712 - DNA, 25 bp, Mus musculus
tttggtttccgctttctcctcctgg

SEQ ID NO: 975713 - DNA, 25 bp, Mus musculus
tttggtttcttcatgtagcacagtc

SEQ ID NO: 975714 - DNA, 25 bp, Mus musculus
tttggtttcttcttgtagcacagtc

SEQ ID NO: 975715 - DNA, 25 bp, Mus musculus
tttggtttgaatatcttatggcctc

SEQ ID NO: 975716 - DNA, 25 bp, Mus musculus
tttggtttgaatttcttatggcctc

SEQ ID NO: 975717 - DNA, 25 bp, Mus musculus
tttggtttgcatacctattttctct

SEQ ID NO: 975718 - DNA, 25 bp, Mus musculus
tttggtttgcattcctattttctct

SEQ ID NO: 975719 - DNA, 25 bp, Mus musculus
tttggtttgccgatttcctgtctgc

SEQ ID NO: 975720 - DNA, 25 bp, Mus musculus
tttggtttgccgttttcctgtctgc

SEQ ID NO: 975721 - DNA, 25 bp, Mus musculus
tttggtttggtcagtgtcagggtct

SEQ ID NO: 975722 - DNA, 25 bp, Mus musculus
tttggtttggtctgtgtcagggtct

SEQ ID NO: 975723 - DNA, 25 bp, Mus musculus
tttggttttagacccttacatctag

SEQ ID NO: 975724 - DNA, 25 bp, Mus musculus
tttggttttagagccttacatctag

SEQ ID NO: 975725 - DNA, 25 bp, Mus musculus
tttggttttatgaggtattacagtt

SEQ ID NO: 975726 - DNA, 25 bp, Mus musculus
tttggttttatgtggtattacagtt

SEQ ID NO: 975727 - DNA, 25 bp, Mus musculus
tttggttttcccagtgctcttgcaa

SEQ ID NO: 975728 - DNA, 25 bp, Mus musculus
tttggttttccctgtgctcttgcaa

SEQ ID NO: 975729 - DNA, 25 bp, Mus musculus
tttggttttctaacaatcgcactga

SEQ ID NO: 975730 - DNA, 25 bp, Mus musculus
tttggttttctatcaatcgcactga

SEQ ID NO: 975731 - DNA, 25 bp, Mus musculus
tttggttttgacagttccctcttgg

SEQ ID NO: 975732 - DNA, 25 bp, Mus musculus
tttggttttgacattcattctaggt

SEQ ID NO: 975733 - DNA, 25 bp, Mus musculus
tttggttttgactgttccctcttgg

SEQ ID NO: 975734 - DNA, 25 bp, Mus musculus
tttggttttgactttcattctaggt

SEQ ID NO: 975735 - DNA, 25 bp, Mus musculus
tttggttttgctaaccattgagaga

SEQ ID NO: 975736 - DNA, 25 bp, Mus musculus
tttggttttgcttaccattgagaga

SEQ ID NO: 975737 - DNA, 25 bp, Mus musculus
tttggttttggaattcaagaacaca

SEQ ID NO: 975738 - DNA, 25 bp, Mus musculus
tttggttttggatttcaagaacaca

SEQ ID NO: 975739 - DNA, 25 bp, Mus musculus
tttggtttttctcgtcctagtgagt

SEQ ID NO: 975740 - DNA, 25 bp, Mus musculus
tttggtttttctggtcctagtgagt

SEQ ID NO: 975741 - DNA, 25 bp, Mus musculus
tttggtttttggctgctatctgaaa

SEQ ID NO: 975742 - DNA, 25 bp, Mus musculus
tttggtttttgggtgctatctgaaa

SEQ ID NO: 975743 - DNA, 25 bp, Mus musculus
tttgtaaaaagcctagccgggcgtg

SEQ ID NO: 975744 - DNA, 25 bp, Mus musculus
tttgtaaaaagcgtagccgggcgtg

SEQ ID NO: 975745 - DNA, 25 bp, Mus musculus
tttgtaaaacttacatgccctcggg

SEQ ID NO: 975746 - DNA, 25 bp, Mus musculus
tttgtaaaactttcatgccctcggg

SEQ ID NO: 975747 - DNA, 25 bp, Mus musculus
tttgtaaacaatcaccgtccctaag

SEQ ID NO: 975748 - DNA, 25 bp, Mus musculus
tttgtaaacaatgaccgtccctaag

SEQ ID NO: 975749 - DNA, 25 bp, Mus musculus
tttgtaaacattcgaatcggaataa

SEQ ID NO: 975750 - DNA, 25 bp, Mus musculus
tttgtaaacattggaatcggaataa

SEQ ID NO: 975751 - DNA, 25 bp, Mus musculus
tttgtaaacgctctgtattcccctc

SEQ ID NO: 975752 - DNA, 25 bp, Mus musculus
tttgtaaacgctgtgtattcccctc

SEQ ID NO: 975753 - DNA, 25 bp, Mus musculus
tttgtaaagccacgcgtctgctgtg

SEQ ID NO: 975754 - DNA, 25 bp, Mus musculus
tttgtaaagccaggcgtctgctgtg

SEQ ID NO: 975755 - DNA, 25 bp, Mus musculus
tttgtaaagtccagcatactcccac

SEQ ID NO: 975756 - DNA, 25 bp, Mus musculus
tttgtaaagtcctgcatactcccac

SEQ ID NO: 975757 - DNA, 25 bp, Mus musculus
tttgtaaagtgcaggcaacccacaa

SEQ ID NO: 975758 - DNA, 25 bp, Mus musculus
tttgtaaagtgctggcaacccacaa

SEQ ID NO: 975759 - DNA, 25 bp, Mus musculus
tttgtaaattctcatcagctgttgt

SEQ ID NO: 975760 - DNA, 25 bp, Mus musculus
tttgtaaattctcttggtcccaagg

SEQ ID NO: 975761 - DNA, 25 bp, Mus musculus
tttgtaaattctgatcagctgttgt

SEQ ID NO: 975762 - DNA, 25 bp, Mus musculus
tttgtaaattctgttggtcccaagg

SEQ ID NO: 975763 - DNA, 25 bp, Mus musculus
tttgtaacacctcatacgcagctta

SEQ ID NO: 975764 - DNA, 25 bp, Mus musculus
tttgtaacacctgatacgcagctta

SEQ ID NO: 975765 - DNA, 25 bp, Mus musculus
tttgtaacagcactcatcatcctca

SEQ ID NO: 975766 - DNA, 25 bp, Mus musculus
tttgtaacagcagtcatcatcctca

SEQ ID NO: 975767 - DNA, 25 bp, Mus musculus
tttgtaacagtgacgggtgagccct

SEQ ID NO: 975768 - DNA, 25 bp, Mus musculus
tttgtaacagtgtcgggtgagccct

SEQ ID NO: 975769 - DNA, 25 bp, Mus musculus
tttgtaacagttcttaaagtcccat

SEQ ID NO: 975770 - DNA, 25 bp, Mus musculus
tttgtaacagttgttaaagtcccat

SEQ ID NO: 975771 - DNA, 25 bp, Mus musculus
tttgtaaccaaccatccctatgagg

SEQ ID NO: 975772 - DNA, 25 bp, Mus musculus
tttgtaaccaacgatccctatgagg

SEQ ID NO: 975773 - DNA, 25 bp, Mus musculus
tttgtaaccagaactacaagcgaaa

SEQ ID NO: 975774 - DNA, 25 bp, Mus musculus
tttgtaaccagaactgacagcgaaa

SEQ ID NO: 975775 - DNA, 25 bp, Mus musculus
tttgtaaccagatctacaagcgaaa

SEQ ID NO: 975776 - DNA, 25 bp, Mus musculus
tttgtaaccagatctgacagcgaaa

SEQ ID NO: 975777 - DNA, 25 bp, Mus musculus
tttgtaaccattcgccggttgagtt

SEQ ID NO: 975778 - DNA, 25 bp, Mus musculus
tttgtaaccattggccggttgagtt

SEQ ID NO: 975779 - DNA, 25 bp, Mus musculus
tttgtaacgttaccgcctggctgtg

SEQ ID NO: 975780 - DNA, 25 bp, Mus musculus
tttgtaacgttagcgcctggctgtg

SEQ ID NO: 975781 - DNA, 25 bp, Mus musculus
tttgtaactaacaggaatttctgat

SEQ ID NO: 975782 - DNA, 25 bp, Mus musculus
tttgtaactaactggaatttctgat

SEQ ID NO: 975783 - DNA, 25 bp, Mus musculus
tttgtaactgatatgcgcttccacc

SEQ ID NO: 975784 - DNA, 25 bp, Mus musculus
tttgtaactgatttgcgcttccacc

SEQ ID NO: 975785 - DNA, 25 bp, Mus musculus
tttgtaacttctcaagtgggccttc

SEQ ID NO: 975786 - DNA, 25 bp, Mus musculus
tttgtaacttctgaagtgggccttc

SEQ ID NO: 975787 - DNA, 25 bp, Mus musculus
tttgtaagacagaggcgctggcacg

SEQ ID NO: 975788 - DNA, 25 bp, Mus musculus
tttgtaagacagtggcgctggcacg

SEQ ID NO: 975789 - DNA, 25 bp, Mus musculus
tttgtaagacgaccctgcagtccac

SEQ ID NO: 975790 - DNA, 25 bp, Mus musculus
tttgtaagacgagcctgcagtccac

SEQ ID NO: 975791 - DNA, 25 bp, Mus musculus
tttgtaagcacaattccctgaaagt

SEQ ID NO: 975792 - DNA, 25 bp, Mus musculus
tttgtaagcacatttccctgaaagt

SEQ ID NO: 975793 - DNA, 25 bp, Mus musculus
tttgtaagcagtcttcacagccttt

SEQ ID NO: 975794 - DNA, 25 bp, Mus musculus
tttgtaagcagtgttcacagccttt

SEQ ID NO: 975795 - DNA, 25 bp, Mus musculus
tttgtaagcgagagctgccagcttt

SEQ ID NO: 975796 - DNA, 25 bp, Mus musculus
tttgtaagcgagtgctgccagcttt

SEQ ID NO: 975797 - DNA, 25 bp, Mus musculus
tttgtaagctgcactgactagcaat

SEQ ID NO: 975798 - DNA, 25 bp, Mus musculus
tttgtaagctgctctgactagcaat

SEQ ID NO: 975799 - DNA, 25 bp, Mus musculus
tttgtaaggaccctgcaagacagca

SEQ ID NO: 975800 - DNA, 25 bp, Mus musculus
tttgtaaggaccgtgcaagacagca

SEQ ID NO: 975801 - DNA, 25 bp, Mus musculus
tttgtaagtgtccagtctttgcaac

SEQ ID NO: 975802 - DNA, 25 bp, Mus musculus
tttgtaagtgtcgagtctttgcaac

SEQ ID NO: 975803 - DNA, 25 bp, Mus musculus
tttgtaagtttcatcaagtgatttc

SEQ ID NO: 975804 - DNA, 25 bp, Mus musculus
tttgtaagtttcttcaagtgatttc

SEQ ID NO: 975805 - DNA, 25 bp, Mus musculus
tttgtaatagcacgcctcggtcccc

SEQ ID NO: 975806 - DNA, 25 bp, Mus musculus
tttgtaatagcaggcctcggtcccc

SEQ ID NO: 975807 - DNA, 25 bp, Mus musculus
tttgtaatcacacttctctcatctt

SEQ ID NO: 975808 - DNA, 25 bp, Mus musculus
tttgtaatcacagttctctcatctt

SEQ ID NO: 975809 - DNA, 25 bp, Mus musculus
tttgtaatgcctattaccccactat

SEQ ID NO: 975810 - DNA, 25 bp, Mus musculus
tttgtaatgccttttaccccactat

SEQ ID NO: 975811 - DNA, 25 bp, Mus musculus
tttgtaatgtggctgttgcacccag

SEQ ID NO: 975812 - DNA, 25 bp, Mus musculus
tttgtaatgtgggtgttgcacccag

SEQ ID NO: 975813 - DNA, 25 bp, Mus musculus
tttgtaattccaactgtcacatttc

SEQ ID NO: 975814 - DNA, 25 bp, Mus musculus
tttgtaattccatctgtcacatttc

SEQ ID NO: 975815 - DNA, 25 bp, Mus musculus
tttgtaattcccaagagccatagtg

SEQ ID NO: 975816 - DNA, 25 bp, Mus musculus
tttgtaattccctagagccatagtg

SEQ ID NO: 975817 - DNA, 25 bp, Mus musculus
tttgtaattcttctgcccatagggc

SEQ ID NO: 975818 - DNA, 25 bp, Mus musculus
tttgtaattcttgtgcccatagggc

SEQ ID NO: 975819 - DNA, 25 bp, Mus musculus
tttgtacaagagatgtgctgtgcta

SEQ ID NO: 975820 - DNA, 25 bp, Mus musculus
tttgtacaagagttgtgctgtgcta

SEQ ID NO: 975821 - DNA, 25 bp, Mus musculus
tttgtacaatgtagcagttctcagc

SEQ ID NO: 975822 - DNA, 25 bp, Mus musculus
tttgtacaatgttgcagttctcagc

SEQ ID NO: 975823 - DNA, 25 bp, Mus musculus
tttgtacacaaaattttctcagttt

SEQ ID NO: 975824 - DNA, 25 bp, Mus musculus
tttgtacacaaatttttctcagttt

SEQ ID NO: 975825 - DNA, 25 bp, Mus musculus
tttgtacacacaaggcccaaggtag

SEQ ID NO: 975826 - DNA, 25 bp, Mus musculus
tttgtacacacatggcccaaggtag

SEQ ID NO: 975827 - DNA, 25 bp, Mus musculus
tttgtacacacgcaatggccagctc

SEQ ID NO: 975828 - DNA, 25 bp, Mus musculus
tttgtacacacggaatggccagctc

SEQ ID NO: 975829 - DNA, 25 bp, Mus musculus
tttgtacacctaaatgcactcagat

SEQ ID NO: 975830 - DNA, 25 bp, Mus musculus
tttgtacacctatatgcactcagat

SEQ ID NO: 975831 - DNA, 25 bp, Mus musculus
tttgtacagctaagtgttttctatg

SEQ ID NO: 975832 - DNA, 25 bp, Mus musculus
tttgtacagctatgtgttttctatg

SEQ ID NO: 975833 - DNA, 25 bp, Mus musculus
tttgtacaggccacaacaaggactt

SEQ ID NO: 975834 - DNA, 25 bp, Mus musculus
tttgtacaggcctcaacaaggactt

SEQ ID NO: 975835 - DNA, 25 bp, Mus musculus
tttgtacagtgtctggtgaccaccc

SEQ ID NO: 975836 - DNA, 25 bp, Mus musculus
tttgtacagtgtgtggtgaccaccc

SEQ ID NO: 975837 - DNA, 25 bp, Mus musculus
tttgtacatcgtagaacccctcaag

SEQ ID NO: 975838 - DNA, 25 bp, Mus musculus
tttgtacatcgttgaacccctcaag

SEQ ID NO: 975839 - DNA, 25 bp, Mus musculus
tttgtacatcttatggcgagtggcc

SEQ ID NO: 975840 - DNA, 25 bp, Mus musculus
tttgtacatcttttggcgagtggcc

SEQ ID NO: 975841 - DNA, 25 bp, Mus musculus
tttgtacattgacacaagccccttc

SEQ ID NO: 975842 - DNA, 25 bp, Mus musculus
tttgtacattgagacaagccccttc

SEQ ID NO: 975843 - DNA, 25 bp, Mus musculus
tttgtaccactcactcactgtcttt

SEQ ID NO: 975844 - DNA, 25 bp, Mus musculus
tttgtaccactctctcactgtcttt

SEQ ID NO: 975845 - DNA, 25 bp, Mus musculus
tttgtaccactgcactgttcgtaac

SEQ ID NO: 975846 - DNA, 25 bp, Mus musculus
tttgtaccactggactgttcgtaac

SEQ ID NO: 975847 - DNA, 25 bp, Mus musculus
tttgtaccagtcactttgaaaacca

SEQ ID NO: 975848 - DNA, 25 bp, Mus musculus
tttgtaccagtctctttgaaaacca

SEQ ID NO: 975849 - DNA, 25 bp, Mus musculus
tttgtaccatctcattgtctggcca

SEQ ID NO: 975850 - DNA, 25 bp, Mus musculus
tttgtaccatctgattgtctggcca

SEQ ID NO: 975851 - DNA, 25 bp, Mus musculus
tttgtacccaaccaagtgggtcaag

SEQ ID NO: 975852 - DNA, 25 bp, Mus musculus
tttgtacccaacgaagtgggtcaag

SEQ ID NO: 975853 - DNA, 25 bp, Mus musculus
tttgtacccacgagcacataaccgc

SEQ ID NO: 975854 - DNA, 25 bp, Mus musculus
tttgtacccacgtgcacataaccgc

SEQ ID NO: 975855 - DNA, 25 bp, Mus musculus
tttgtaccgattacgctgaagcgtc

SEQ ID NO: 975856 - DNA, 25 bp, Mus musculus
tttgtaccgatttcgctgaagcgtc

SEQ ID NO: 975857 - DNA, 25 bp, Mus musculus
tttgtacctggaagacctctgcata

SEQ ID NO: 975858 - DNA, 25 bp, Mus musculus
tttgtacctggatgacctctgcata

SEQ ID NO: 975859 - DNA, 25 bp, Mus musculus
tttgtacctttgaagatttgtcttt

SEQ ID NO: 975860 - DNA, 25 bp, Mus musculus
tttgtacctttgagggagggatgca

SEQ ID NO: 975861 - DNA, 25 bp, Mus musculus
tttgtacctttgtagatttgtcttt

SEQ ID NO: 975862 - DNA, 25 bp, Mus musculus
tttgtacctttgtgggagggatgca

SEQ ID NO: 975863 - DNA, 25 bp, Mus musculus
tttgtacgcccacgtgctctagtgg

SEQ ID NO: 975864 - DNA, 25 bp, Mus musculus
tttgtacgcccaggtgctctagtgg

SEQ ID NO: 975865 - DNA, 25 bp, Mus musculus
tttgtactaaggaccaactccaaga

SEQ ID NO: 975866 - DNA, 25 bp, Mus musculus
tttgtactaaggtccaactccaaga

SEQ ID NO: 975867 - DNA, 25 bp, Mus musculus
tttgtactaagtaaatccttgccca

SEQ ID NO: 975868 - DNA, 25 bp, Mus musculus
tttgtactaagtattcctcgttgct

SEQ ID NO: 975869 - DNA, 25 bp, Mus musculus
tttgtactaagttaatccttgccca

SEQ ID NO: 975870 - DNA, 25 bp, Mus musculus
tttgtactaagttttcctcgttgct

SEQ ID NO: 975871 - DNA, 25 bp, Mus musculus
tttgtactcacactccttgtccgtg

SEQ ID NO: 975872 - DNA, 25 bp, Mus musculus
tttgtactcacagtccttgtccgtg

SEQ ID NO: 975873 - DNA, 25 bp, Mus musculus
tttgtactcatcaccatttcttctc

SEQ ID NO: 975874 - DNA, 25 bp, Mus musculus
tttgtactcatctccatttcttctc

SEQ ID NO: 975875 - DNA, 25 bp, Mus musculus
tttgtactccatatgcaagttaggg

SEQ ID NO: 975876 - DNA, 25 bp, Mus musculus
tttgtactccatttgcaagttaggg

SEQ ID NO: 975877 - DNA, 25 bp, Mus musculus
tttgtactctgactgtgctcatttt

SEQ ID NO: 975878 - DNA, 25 bp, Mus musculus
tttgtactctgagtgtgctcatttt

SEQ ID NO: 975879 - DNA, 25 bp, Mus musculus
tttgtactgaagcagctttcggcta

SEQ ID NO: 975880 - DNA, 25 bp, Mus musculus
tttgtactgaaggagctttcggcta

SEQ ID NO: 975881 - DNA, 25 bp, Mus musculus
tttgtactgtgaattccttttgggt

SEQ ID NO: 975882 - DNA, 25 bp, Mus musculus
tttgtactgtgatttccttttgggt

SEQ ID NO: 975883 - DNA, 25 bp, Mus musculus
tttgtactgtgcactctttcccatt

SEQ ID NO: 975884 - DNA, 25 bp, Mus musculus
tttgtactgtgctctctttcccatt

SEQ ID NO: 975885 - DNA, 25 bp, Mus musculus
tttgtactgtggaatgtgcttaata

SEQ ID NO: 975886 - DNA, 25 bp, Mus musculus
tttgtactgtggagttagaaaccag

SEQ ID NO: 975887 - DNA, 25 bp, Mus musculus
tttgtactgtggtatgtgcttaata

SEQ ID NO: 975888 - DNA, 25 bp, Mus musculus
tttgtactgtggtgttagaaaccag

SEQ ID NO: 975889 - DNA, 25 bp, Mus musculus
tttgtacttagaatttgaactcttg

SEQ ID NO: 975890 - DNA, 25 bp, Mus musculus
tttgtacttagattttgaactcttg

SEQ ID NO: 975891 - DNA, 25 bp, Mus musculus
tttgtacttgatcccttgtttcccc

SEQ ID NO: 975892 - DNA, 25 bp, Mus musculus
tttgtacttgatgccttgtttcccc

SEQ ID NO: 975893 - DNA, 25 bp, Mus musculus
tttgtactttgcaggtgacgatgaa

SEQ ID NO: 975894 - DNA, 25 bp, Mus musculus
tttgtactttgctggtgacgatgaa

SEQ ID NO: 975895 - DNA, 25 bp, Mus musculus
tttgtactttgtattcctgaagaga

SEQ ID NO: 975896 - DNA, 25 bp, Mus musculus
tttgtactttgttttcctgaagaga

SEQ ID NO: 975897 - DNA, 25 bp, Mus musculus
tttgtacttttaagaccagtcagaa

SEQ ID NO: 975898 - DNA, 25 bp, Mus musculus
tttgtacttttatgaccagtcagaa

SEQ ID NO: 975899 - DNA, 25 bp, Mus musculus
tttgtactttttcgcctgggacatg

SEQ ID NO: 975900 - DNA, 25 bp, Mus musculus
tttgtactttttggcctgggacatg

SEQ ID NO: 975901 - DNA, 25 bp, Mus musculus
tttgtagaaaccagacttccccact

SEQ ID NO: 975902 - DNA, 25 bp, Mus musculus
tttgtagaaacctgacttccccact

SEQ ID NO: 975903 - DNA, 25 bp, Mus musculus
tttgtagaacaaacagggcagtgac

SEQ ID NO: 975904 - DNA, 25 bp, Mus musculus
tttgtagaacaatcagggcagtgac

SEQ ID NO: 975905 - DNA, 25 bp, Mus musculus
tttgtagaattccaggtctctccac

SEQ ID NO: 975906 - DNA, 25 bp, Mus musculus
tttgtagaattcgaggtctctccac

SEQ ID NO: 975907 - DNA, 25 bp, Mus musculus
tttgtagaccccaacgttgacggtg

SEQ ID NO: 975908 - DNA, 25 bp, Mus musculus
tttgtagacccctacgttgacggtg

SEQ ID NO: 975909 - DNA, 25 bp, Mus musculus
tttgtagactaaacctcacctttgc

SEQ ID NO: 975910 - DNA, 25 bp, Mus musculus
tttgtagactaatcctcacctttgc

SEQ ID NO: 975911 - DNA, 25 bp, Mus musculus
tttgtagactcgagaccaccctgag

SEQ ID NO: 975912 - DNA, 25 bp, Mus musculus
tttgtagactcgtgaccaccctgag

SEQ ID NO: 975913 - DNA, 25 bp, Mus musculus
tttgtagagagcagcttcagccgct

SEQ ID NO: 975914 - DNA, 25 bp, Mus musculus
tttgtagagagctgcttcagccgct

SEQ ID NO: 975915 - DNA, 25 bp, Mus musculus
tttgtagagggcaccggcagcctag

SEQ ID NO: 975916 - DNA, 25 bp, Mus musculus
tttgtagagggctccggcagcctag

SEQ ID NO: 975917 - DNA, 25 bp, Mus musculus
tttgtagaggtgaagtacccctgga

SEQ ID NO: 975918 - DNA, 25 bp, Mus musculus
tttgtagaggtgtagtacccctgga

SEQ ID NO: 975919 - DNA, 25 bp, Mus musculus
tttgtagatatcaacatccttttgt

SEQ ID NO: 975920 - DNA, 25 bp, Mus musculus
tttgtagatatctacatccttttgt

SEQ ID NO: 975921 - DNA, 25 bp, Mus musculus
tttgtagatgccattcctctcgtaa

SEQ ID NO: 975922 - DNA, 25 bp, Mus musculus
tttgtagatgcctttcctctcgtaa

SEQ ID NO: 975923 - DNA, 25 bp, Mus musculus
tttgtagcaatgaacccacactggg

SEQ ID NO: 975924 - DNA, 25 bp, Mus musculus
tttgtagcaatgtacccacactggg

SEQ ID NO: 975925 - DNA, 25 bp, Mus musculus
tttgtagcaccactgtagcgccctg

SEQ ID NO: 975926 - DNA, 25 bp, Mus musculus
tttgtagcaccagtgtagcgccctg

SEQ ID NO: 975927 - DNA, 25 bp, Mus musculus
tttgtagcacgtcacttactgcacc

SEQ ID NO: 975928 - DNA, 25 bp, Mus musculus
tttgtagcacgtgacttactgcacc

SEQ ID NO: 975929 - DNA, 25 bp, Mus musculus
tttgtagcagctcccaaacaggtct

SEQ ID NO: 975930 - DNA, 25 bp, Mus musculus
tttgtagcagctgccaaacaggtct

SEQ ID NO: 975931 - DNA, 25 bp, Mus musculus
tttgtagcagtaaccttcagtgtat

SEQ ID NO: 975932 - DNA, 25 bp, Mus musculus
tttgtagcagtatccttcagtgtat

SEQ ID NO: 975933 - DNA, 25 bp, Mus musculus
tttgtagccaaacggacatctgagg

SEQ ID NO: 975934 - DNA, 25 bp, Mus musculus
tttgtagccaaagggacatctgagg

SEQ ID NO: 975935 - DNA, 25 bp, Mus musculus
tttgtagccagcaacagagcagatg

SEQ ID NO: 975936 - DNA, 25 bp, Mus musculus
tttgtagccagctacagagcagatg

SEQ ID NO: 975937 - DNA, 25 bp, Mus musculus
tttgtagccatactgatcggcctgt

SEQ ID NO: 975938 - DNA, 25 bp, Mus musculus
tttgtagccatagtgatcggcctgt

SEQ ID NO: 975939 - DNA, 25 bp, Mus musculus
tttgtagcctggctcatccttaagc

SEQ ID NO: 975940 - DNA, 25 bp, Mus musculus
tttgtagcctgggtcatccttaagc

SEQ ID NO: 975941 - DNA, 25 bp, Mus musculus
tttgtagctcaacaccccatactta

SEQ ID NO: 975942 - DNA, 25 bp, Mus musculus
tttgtagctcaagaccccatactta

SEQ ID NO: 975943 - DNA, 25 bp, Mus musculus
tttgtagctcgcctgctgactggtc

SEQ ID NO: 975944 - DNA, 25 bp, Mus musculus
tttgtagctcgcgtgctgactggtc

SEQ ID NO: 975945 - DNA, 25 bp, Mus musculus
tttgtagctctacctagttaagtct

SEQ ID NO: 975946 - DNA, 25 bp, Mus musculus
tttgtagctctagctagttaagtct

SEQ ID NO: 975947 - DNA, 25 bp, Mus musculus
tttgtagctgagaacgtggaacccc

SEQ ID NO: 975948 - DNA, 25 bp, Mus musculus
tttgtagctgagtacgtggaacccc

SEQ ID NO: 975949 - DNA, 25 bp, Mus musculus
tttgtagctgtcagagtgtgttaaa

SEQ ID NO: 975950 - DNA, 25 bp, Mus musculus
tttgtagctgtctgagtgtgttaaa

SEQ ID NO: 975951 - DNA, 25 bp, Mus musculus
tttgtaggacttacccaaggcccag

SEQ ID NO: 975952 - DNA, 25 bp, Mus musculus
tttgtaggactttcccaaggcccag

SEQ ID NO: 975953 - DNA, 25 bp, Mus musculus
tttgtaggcttcatcctcttttctt

SEQ ID NO: 975954 - DNA, 25 bp, Mus musculus
tttgtaggcttcttcctcttttctt

SEQ ID NO: 975955 - DNA, 25 bp, Mus musculus
tttgtaggttagattctgggaagca

SEQ ID NO: 975956 - DNA, 25 bp, Mus musculus
tttgtaggttagtttctgggaagca

SEQ ID NO: 975957 - DNA, 25 bp, Mus musculus
tttgtagtcaacaccacatcttgtt

SEQ ID NO: 975958 - DNA, 25 bp, Mus musculus
tttgtagtcaactccacatcttgtt

SEQ ID NO: 975959 - DNA, 25 bp, Mus musculus
tttgtagtccacatgtatgtaagac

SEQ ID NO: 975960 - DNA, 25 bp, Mus musculus
tttgtagtccacttgtatgtaagac

SEQ ID NO: 975961 - DNA, 25 bp, Mus musculus
tttgtagtgacccattatacccctt

SEQ ID NO: 975962 - DNA, 25 bp, Mus musculus
tttgtagtgaccgattatacccctt

SEQ ID NO: 975963 - DNA, 25 bp, Mus musculus
tttgtagtgtatctccttacatgta

SEQ ID NO: 975964 - DNA, 25 bp, Mus musculus
tttgtagtgtatgtccttacatgta

SEQ ID NO: 975965 - DNA, 25 bp, Mus musculus
tttgtagtgtgcagtaaacgtttgt

SEQ ID NO: 975966 - DNA, 25 bp, Mus musculus
tttgtagtgtgctgtaaacgtttgt

SEQ ID NO: 975967 - DNA, 25 bp, Mus musculus
tttgtagttctgcacttcggcatag

SEQ ID NO: 975968 - DNA, 25 bp, Mus musculus
tttgtagttctggacttcggcatag

SEQ ID NO: 975969 - DNA, 25 bp, Mus musculus
tttgtagtttttcatgagtatttaa

SEQ ID NO: 975970 - DNA, 25 bp, Mus musculus
tttgtagtttttgatgagtatttaa

SEQ ID NO: 975971 - DNA, 25 bp, Mus musculus
tttgtataaagtcccctggaaccag

SEQ ID NO: 975972 - DNA, 25 bp, Mus musculus
tttgtataaagtgccctggaaccag

SEQ ID NO: 975973 - DNA, 25 bp, Mus musculus
tttgtataaatgctactatgtacta

SEQ ID NO: 975974 - DNA, 25 bp, Mus musculus
tttgtataaatggtactatgtacta

SEQ ID NO: 975975 - DNA, 25 bp, Mus musculus
tttgtataacttcccctcaccaaca

SEQ ID NO: 975976 - DNA, 25 bp, Mus musculus
tttgtataacttgccctcaccaaca

SEQ ID NO: 975977 - DNA, 25 bp, Mus musculus
tttgtatacgtcctgggtaatgaga

SEQ ID NO: 975978 - DNA, 25 bp, Mus musculus
tttgtatacgtcgtgggtaatgaga

SEQ ID NO: 975979 - DNA, 25 bp, Mus musculus
tttgtatagacacctacccgactga

SEQ ID NO: 975980 - DNA, 25 bp, Mus musculus
tttgtatagacagctacccgactga

SEQ ID NO: 975981 - DNA, 25 bp, Mus musculus
tttgtatagcagacacacctttgat

SEQ ID NO: 975982 - DNA, 25 bp, Mus musculus
tttgtatagcagctgctccctgaat

SEQ ID NO: 975983 - DNA, 25 bp, Mus musculus
tttgtatagcaggtgctccctgaat

SEQ ID NO: 975984 - DNA, 25 bp, Mus musculus
tttgtatagcagtcacacctttgat

SEQ ID NO: 975985 - DNA, 25 bp, Mus musculus
tttgtatataccattcacttgcctg

SEQ ID NO: 975986 - DNA, 25 bp, Mus musculus
tttgtatatacctttcacttgcctg

SEQ ID NO: 975987 - DNA, 25 bp, Mus musculus
tttgtatatagcaacctggcccagt

SEQ ID NO: 975988 - DNA, 25 bp, Mus musculus
tttgtatatagctacctggcccagt

SEQ ID NO: 975989 - DNA, 25 bp, Mus musculus
tttgtatatgcaaaaccagggtggt

SEQ ID NO: 975990 - DNA, 25 bp, Mus musculus
tttgtatatgcataaccagggtggt

SEQ ID NO: 975991 - DNA, 25 bp, Mus musculus
tttgtatattgcatgacatccgtat

SEQ ID NO: 975992 - DNA, 25 bp, Mus musculus
tttgtatattgcttgacatccgtat

SEQ ID NO: 975993 - DNA, 25 bp, Mus musculus
tttgtatcagtcagctttctctctc

SEQ ID NO: 975994 - DNA, 25 bp, Mus musculus
tttgtatcagtctgctttctctctc

SEQ ID NO: 975995 - DNA, 25 bp, Mus musculus
tttgtatccaagctgctgaatcttg

SEQ ID NO: 975996 - DNA, 25 bp, Mus musculus
tttgtatccaaggtgctgaatcttg

SEQ ID NO: 975997 - DNA, 25 bp, Mus musculus
tttgtatccttcaagtcgctcactg

SEQ ID NO: 975998 - DNA, 25 bp, Mus musculus
tttgtatccttctagtcgctcactg

SEQ ID NO: 975999 - DNA, 25 bp, Mus musculus
tttgtatcgctcataccatatgcct

SEQ ID NO: 976000 - DNA, 25 bp, Mus musculus
tttgtatcgctcttaccatatgcct

SEQ ID NO: 976001 - DNA, 25 bp, Mus musculus
tttgtatctattatggtctccttgt

SEQ ID NO: 976002 - DNA, 25 bp, Mus musculus
tttgtatctattttggtctccttgt

SEQ ID NO: 976003 - DNA, 25 bp, Mus musculus
tttgtatctgataaaagaagcacat

SEQ ID NO: 976004 - DNA, 25 bp, Mus musculus
tttgtatctgattaaagaagcacat

SEQ ID NO: 976005 - DNA, 25 bp, Mus musculus
tttgtatctggaatcccatctgcag

SEQ ID NO: 976006 - DNA, 25 bp, Mus musculus
tttgtatctggattcccatctgcag

SEQ ID NO: 976007 - DNA, 25 bp, Mus musculus
tttgtatgaaatagcagtgccttgc

SEQ ID NO: 976008 - DNA, 25 bp, Mus musculus
tttgtatgaaattgcagtgccttgc

SEQ ID NO: 976009 - DNA, 25 bp, Mus musculus
tttgtatgagacctcaacgccggca

SEQ ID NO: 976010 - DNA, 25 bp, Mus musculus
tttgtatgagacgtcaacgccggca

SEQ ID NO: 976011 - DNA, 25 bp, Mus musculus
tttgtatgatttctctctccttctg

SEQ ID NO: 976012 - DNA, 25 bp, Mus musculus
tttgtatgatttgtctctccttctg

SEQ ID NO: 976013 - DNA, 25 bp, Mus musculus
tttgtatgcaaacatggctctcccc

SEQ ID NO: 976014 - DNA, 25 bp, Mus musculus
tttgtatgcaaagatggctctcccc

SEQ ID NO: 976015 - DNA, 25 bp, Mus musculus
tttgtatgcattctggacgtctgaa

SEQ ID NO: 976016 - DNA, 25 bp, Mus musculus
tttgtatgcattgtggacgtctgaa

SEQ ID NO: 976017 - DNA, 25 bp, Mus musculus
tttgtatgccatattgactcagttt

SEQ ID NO: 976018 - DNA, 25 bp, Mus musculus
tttgtatgccattttgactcagttt

SEQ ID NO: 976019 - DNA, 25 bp, Mus musculus
tttgtatgccggatatgtgccattc

SEQ ID NO: 976020 - DNA, 25 bp, Mus musculus
tttgtatgccggttatgtgccattc

SEQ ID NO: 976021 - DNA, 25 bp, Mus musculus
tttgtatgcctgagtttgagtacac

SEQ ID NO: 976022 - DNA, 25 bp, Mus musculus
tttgtatgcctgtgtttgagtacac

SEQ ID NO: 976023 - DNA, 25 bp, Mus musculus
tttgtatgggttactaccctctgcc

SEQ ID NO: 976024 - DNA, 25 bp, Mus musculus
tttgtatgggtttctaccctctgcc

SEQ ID NO: 976025 - DNA, 25 bp, Mus musculus
tttgtatggtggcagctagctcccc

SEQ ID NO: 976026 - DNA, 25 bp, Mus musculus
tttgtatggtgggagctagctcccc

SEQ ID NO: 976027 - DNA, 25 bp, Mus musculus
tttgtatgtcatatccccgtaactc

SEQ ID NO: 976028 - DNA, 25 bp, Mus musculus
tttgtatgtcatttccccgtaactc

SEQ ID NO: 976029 - DNA, 25 bp, Mus musculus
tttgtatgtgctccctcattttaaa

SEQ ID NO: 976030 - DNA, 25 bp, Mus musculus
tttgtatgtgctgcctcattttaaa

SEQ ID NO: 976031 - DNA, 25 bp, Mus musculus
tttgtatgttctaaggagccctcct

SEQ ID NO: 976032 - DNA, 25 bp, Mus musculus
tttgtatgttcttaggagccctcct

SEQ ID NO: 976033 - DNA, 25 bp, Mus musculus
tttgtattgtcgattgcagcactct

SEQ ID NO: 976034 - DNA, 25 bp, Mus musculus
tttgtattgtcgtttgcagcactct

SEQ ID NO: 976035 - DNA, 25 bp, Mus musculus
tttgtatttagcctcctctgtataa

SEQ ID NO: 976036 - DNA, 25 bp, Mus musculus
tttgtatttagcgtcctctgtataa

SEQ ID NO: 976037 - DNA, 25 bp, Mus musculus
tttgtatttgcacagtcagtatggc

SEQ ID NO: 976038 - DNA, 25 bp, Mus musculus
tttgtatttgcagagtcagtatggc

SEQ ID NO: 976039 - DNA, 25 bp, Mus musculus
tttgtattttacatgggccagttta

SEQ ID NO: 976040 - DNA, 25 bp, Mus musculus
tttgtattttacctgcttgcatgcc

SEQ ID NO: 976041 - DNA, 25 bp, Mus musculus
tttgtattttacgtgcttgcatgcc

SEQ ID NO: 976042 - DNA, 25 bp, Mus musculus
tttgtattttacttgggccagttta

SEQ ID NO: 976043 - DNA, 25 bp, Mus musculus
tttgtatttttcatcctatgctgaa

SEQ ID NO: 976044 - DNA, 25 bp, Mus musculus
tttgtatttttcttcctatgctgaa

SEQ ID NO: 976045 - DNA, 25 bp, Mus musculus
tttgtcaaattcaactgtgcttaac

SEQ ID NO: 976046 - DNA, 25 bp, Mus musculus
tttgtcaaattctactgtgcttaac

SEQ ID NO: 976047 - DNA, 25 bp, Mus musculus
tttgtcaacttcaatgtgatataaa

SEQ ID NO: 976048 - DNA, 25 bp, Mus musculus
tttgtcaacttctatgtgatataaa

SEQ ID NO: 976049 - DNA, 25 bp, Mus musculus
tttgtcaagcagcacctttgtggtt

SEQ ID NO: 976050 - DNA, 25 bp, Mus musculus
tttgtcaagcaggacctttgtggtt

SEQ ID NO: 976051 - DNA, 25 bp, Mus musculus
tttgtcaagctcatcacatgtctga

SEQ ID NO: 976052 - DNA, 25 bp, Mus musculus
tttgtcaagctcttcacatgtctga

SEQ ID NO: 976053 - DNA, 25 bp, Mus musculus
tttgtcaagtctctgcaacgctgca

SEQ ID NO: 976054 - DNA, 25 bp, Mus musculus
tttgtcaagtctgtgcaacgctgca

SEQ ID NO: 976055 - DNA, 25 bp, Mus musculus
tttgtcaagttcaccttctgtttag

SEQ ID NO: 976056 - DNA, 25 bp, Mus musculus
tttgtcaagttctccttctgtttag

SEQ ID NO: 976057 - DNA, 25 bp, Mus musculus
tttgtcaataccacatctgtggatt

SEQ ID NO: 976058 - DNA, 25 bp, Mus musculus
tttgtcaatacctcatctgtggatt

SEQ ID NO: 976059 - DNA, 25 bp, Mus musculus
tttgtcaatcatatcctactagttt

SEQ ID NO: 976060 - DNA, 25 bp, Mus musculus
tttgtcaatcatttcctactagttt

SEQ ID NO: 976061 - DNA, 25 bp, Mus musculus
tttgtcaatggcatacaggctgcta

SEQ ID NO: 976062 - DNA, 25 bp, Mus musculus
tttgtcaatggcttacaggctgcta

SEQ ID NO: 976063 - DNA, 25 bp, Mus musculus
tttgtcaatgtcagtcccctattcc

SEQ ID NO: 976064 - DNA, 25 bp, Mus musculus
tttgtcaatgtctgtcccctattcc

SEQ ID NO: 976065 - DNA, 25 bp, Mus musculus
tttgtcacacaaatgtcccaggaat

SEQ ID NO: 976066 - DNA, 25 bp, Mus musculus
tttgtcacacaattgtcccaggaat

SEQ ID NO: 976067 - DNA, 25 bp, Mus musculus
tttgtcacaccgactcctcttggga

SEQ ID NO: 976068 - DNA, 25 bp, Mus musculus
tttgtcacaccgtctcctcttggga

SEQ ID NO: 976069 - DNA, 25 bp, Mus musculus
tttgtcacactcataaggaccttgg

SEQ ID NO: 976070 - DNA, 25 bp, Mus musculus
tttgtcacactcattcaacctagct

SEQ ID NO: 976071 - DNA, 25 bp, Mus musculus
tttgtcacactcttaaggaccttgg

SEQ ID NO: 976072 - DNA, 25 bp, Mus musculus
tttgtcacactctttcaacctagct

SEQ ID NO: 976073 - DNA, 25 bp, Mus musculus
tttgtcacatttatcatcctgccct

SEQ ID NO: 976074 - DNA, 25 bp, Mus musculus
tttgtcacatttttcatcctgccct

SEQ ID NO: 976075 - DNA, 25 bp, Mus musculus
tttgtcaccacacagaattgcccct

SEQ ID NO: 976076 - DNA, 25 bp, Mus musculus
tttgtcaccacagagaattgcccct

SEQ ID NO: 976077 - DNA, 25 bp, Mus musculus
tttgtcaccatcacttttctaggcc

SEQ ID NO: 976078 - DNA, 25 bp, Mus musculus
tttgtcaccatctcttttctaggcc

SEQ ID NO: 976079 - DNA, 25 bp, Mus musculus
tttgtcacccctcgataaagaaagt

SEQ ID NO: 976080 - DNA, 25 bp, Mus musculus
tttgtcacccctggataaagaaagt

SEQ ID NO: 976081 - DNA, 25 bp, Mus musculus
tttgtcaccctgcaaaatcagcata

SEQ ID NO: 976082 - DNA, 25 bp, Mus musculus
tttgtcaccctggaaaatcagcata

SEQ ID NO: 976083 - DNA, 25 bp, Mus musculus
tttgtcaccttgacaagggtcccag

SEQ ID NO: 976084 - DNA, 25 bp, Mus musculus
tttgtcaccttgtcaagggtcccag

SEQ ID NO: 976085 - DNA, 25 bp, Mus musculus
tttgtcactaagctttaggtcactt

SEQ ID NO: 976086 - DNA, 25 bp, Mus musculus
tttgtcactaaggtttaggtcactt

SEQ ID NO: 976087 - DNA, 25 bp, Mus musculus
tttgtcactgccaatgtggtaatgc

SEQ ID NO: 976088 - DNA, 25 bp, Mus musculus
tttgtcactgcctatgtggtaatgc

SEQ ID NO: 976089 - DNA, 25 bp, Mus musculus
tttgtcactggaatcataatttgaa

SEQ ID NO: 976090 - DNA, 25 bp, Mus musculus
tttgtcactggattcataatttgaa

SEQ ID NO: 976091 - DNA, 25 bp, Mus musculus
tttgtcactgtaagtcactgcaccc

SEQ ID NO: 976092 - DNA, 25 bp, Mus musculus
tttgtcactgtatgtcactgcaccc

SEQ ID NO: 976093 - DNA, 25 bp, Mus musculus
tttgtcacttatactcacagtctcc

SEQ ID NO: 976094 - DNA, 25 bp, Mus musculus
tttgtcacttattctcacagtctcc

SEQ ID NO: 976095 - DNA, 25 bp, Mus musculus
tttgtcacttccagtagccagtgta

SEQ ID NO: 976096 - DNA, 25 bp, Mus musculus
tttgtcacttcctgtagccagtgta

SEQ ID NO: 976097 - DNA, 25 bp, Mus musculus
tttgtcagaccaagcaatgcagcct

SEQ ID NO: 976098 - DNA, 25 bp, Mus musculus
tttgtcagaccatgcaatgcagcct

SEQ ID NO: 976099 - DNA, 25 bp, Mus musculus
tttgtcagatgaacaagccccacac

SEQ ID NO: 976100 - DNA, 25 bp, Mus musculus
tttgtcagatgatcaagccccacac

SEQ ID NO: 976101 - DNA, 25 bp, Mus musculus
tttgtcagccaaaatgtctgtcata

SEQ ID NO: 976102 - DNA, 25 bp, Mus musculus
tttgtcagccaatatgtctgtcata

SEQ ID NO: 976103 - DNA, 25 bp, Mus musculus
tttgtcagcgccaggtgtctggatc

SEQ ID NO: 976104 - DNA, 25 bp, Mus musculus
tttgtcagcgcctggtgtctggatc

SEQ ID NO: 976105 - DNA, 25 bp, Mus musculus
tttgtcagcgcgcatggatttgttg

SEQ ID NO: 976106 - DNA, 25 bp, Mus musculus
tttgtcagcgcggatggatttgttg

SEQ ID NO: 976107 - DNA, 25 bp, Mus musculus
tttgtcagcgctatcattctcttgc

SEQ ID NO: 976108 - DNA, 25 bp, Mus musculus
tttgtcagcgctttcattctcttgc

SEQ ID NO: 976109 - DNA, 25 bp, Mus musculus
tttgtcaggtccacagtcattcagt

SEQ ID NO: 976110 - DNA, 25 bp, Mus musculus
tttgtcaggtcctcagtcattcagt

SEQ ID NO: 976111 - DNA, 25 bp, Mus musculus
tttgtcagtgacctcatataccaga

SEQ ID NO: 976112 - DNA, 25 bp, Mus musculus
tttgtcagtgacgtcatataccaga

SEQ ID NO: 976113 - DNA, 25 bp, Mus musculus
tttgtcagtggtctgcttcttagtc

SEQ ID NO: 976114 - DNA, 25 bp, Mus musculus
tttgtcagtggtgtgcttcttagtc

SEQ ID NO: 976115 - DNA, 25 bp, Mus musculus
tttgtcagttttacctgtcttgcag

SEQ ID NO: 976116 - DNA, 25 bp, Mus musculus
tttgtcagtttttcctgtcttgcag

SEQ ID NO: 976117 - DNA, 25 bp, Mus musculus
tttgtcatagtaattccaccactcc

SEQ ID NO: 976118 - DNA, 25 bp, Mus musculus
tttgtcatagtatttccaccactcc

SEQ ID NO: 976119 - DNA, 25 bp, Mus musculus
tttgtcatcactcctattctgttgt

SEQ ID NO: 976120 - DNA, 25 bp, Mus musculus
tttgtcatcactgctattctgttgt

SEQ ID NO: 976121 - DNA, 25 bp, Mus musculus
tttgtcatcttcatcactctcatag

SEQ ID NO: 976122 - DNA, 25 bp, Mus musculus
tttgtcatcttcttcactctcatag

SEQ ID NO: 976123 - DNA, 25 bp, Mus musculus
tttgtcatctttacagctttctgga

SEQ ID NO: 976124 - DNA, 25 bp, Mus musculus
tttgtcatcttttcagctttctgga

SEQ ID NO: 976125 - DNA, 25 bp, Mus musculus
tttgtcatgggcagcctagacacag

SEQ ID NO: 976126 - DNA, 25 bp, Mus musculus
tttgtcatgggctgcctagacacag

SEQ ID NO: 976127 - DNA, 25 bp, Mus musculus
tttgtcatgtataactgtgcccgcc

SEQ ID NO: 976128 - DNA, 25 bp, Mus musculus
tttgtcatgtattactgtgcccgcc

SEQ ID NO: 976129 - DNA, 25 bp, Mus musculus
tttgtcatgttaaggccagtcgtcc

SEQ ID NO: 976130 - DNA, 25 bp, Mus musculus
tttgtcatgttatggccagtcgtcc

SEQ ID NO: 976131 - DNA, 25 bp, Mus musculus
tttgtcatgtttatcacttactgtt

SEQ ID NO: 976132 - DNA, 25 bp, Mus musculus
tttgtcatgtttttcacttactgtt

SEQ ID NO: 976133 - DNA, 25 bp, Mus musculus
tttgtcatttgcaaggtccaaccct

SEQ ID NO: 976134 - DNA, 25 bp, Mus musculus
tttgtcatttgctaggtccaaccct

SEQ ID NO: 976135 - DNA, 25 bp, Mus musculus
tttgtccaatccaatatccttgtcc

SEQ ID NO: 976136 - DNA, 25 bp, Mus musculus
tttgtccaatcctatatccttgtcc

SEQ ID NO: 976137 - DNA, 25 bp, Mus musculus
tttgtccacaaaaacttccccattg

SEQ ID NO: 976138 - DNA, 25 bp, Mus musculus
tttgtccacaaatacttccccattg

SEQ ID NO: 976139 - DNA, 25 bp, Mus musculus
tttgtccacaagaaacccacgggat

SEQ ID NO: 976140 - DNA, 25 bp, Mus musculus
tttgtccacaagtaacccacgggat

SEQ ID NO: 976141 - DNA, 25 bp, Mus musculus
tttgtccacaccatatggagtctgt

SEQ ID NO: 976142 - DNA, 25 bp, Mus musculus
tttgtccacaccttatggagtctgt

SEQ ID NO: 976143 - DNA, 25 bp, Mus musculus
tttgtccacatcacaatccttagag

SEQ ID NO: 976144 - DNA, 25 bp, Mus musculus
tttgtccacatctcaatccttagag

SEQ ID NO: 976145 - DNA, 25 bp, Mus musculus
tttgtccactttcttgggctcattt

SEQ ID NO: 976146 - DNA, 25 bp, Mus musculus
tttgtccactttgttgggctcattt

SEQ ID NO: 976147 - DNA, 25 bp, Mus musculus
tttgtccagcacatcactatttttg

SEQ ID NO: 976148 - DNA, 25 bp, Mus musculus
tttgtccagcacttcactatttttg

SEQ ID NO: 976149 - DNA, 25 bp, Mus musculus
tttgtccaggaacctgtctgtccat

SEQ ID NO: 976150 - DNA, 25 bp, Mus musculus
tttgtccaggaagctgtctgtccat

SEQ ID NO: 976151 - DNA, 25 bp, Mus musculus
tttgtccatctgaaaaaccttccca

SEQ ID NO: 976152 - DNA, 25 bp, Mus musculus
tttgtccatctgtaaaaccttccca

SEQ ID NO: 976153 - DNA, 25 bp, Mus musculus
tttgtccattttcctattgtggcgg

SEQ ID NO: 976154 - DNA, 25 bp, Mus musculus
tttgtccattttgctattgtggcgg

SEQ ID NO: 976155 - DNA, 25 bp, Mus musculus
tttgtcccacccagctaagtttaca

SEQ ID NO: 976156 - DNA, 25 bp, Mus musculus
tttgtcccaccctgctaagtttaca

SEQ ID NO: 976157 - DNA, 25 bp, Mus musculus
tttgtcccagctattcagaacttac

SEQ ID NO: 976158 - DNA, 25 bp, Mus musculus
tttgtcccagcttttcagaacttac

SEQ ID NO: 976159 - DNA, 25 bp, Mus musculus
tttgtcccaggcctacaatgcgtat

SEQ ID NO: 976160 - DNA, 25 bp, Mus musculus
tttgtcccaggcgtacaatgcgtat

SEQ ID NO: 976161 - DNA, 25 bp, Mus musculus
tttgtcccaggtaggagtccctgct

SEQ ID NO: 976162 - DNA, 25 bp, Mus musculus
tttgtcccaggttggagtccctgct

SEQ ID NO: 976163 - DNA, 25 bp, Mus musculus
tttgtcccatgtctcttgagtgtga

SEQ ID NO: 976164 - DNA, 25 bp, Mus musculus
tttgtcccatgtgtcttgagtgtga

SEQ ID NO: 976165 - DNA, 25 bp, Mus musculus
tttgtccccacacttggcgacaggg

SEQ ID NO: 976166 - DNA, 25 bp, Mus musculus
tttgtccccacagttggcgacaggg

SEQ ID NO: 976167 - DNA, 25 bp, Mus musculus
tttgtccccagtattgtcacatcac

SEQ ID NO: 976168 - DNA, 25 bp, Mus musculus
tttgtccccagttttgtcacatcac

SEQ ID NO: 976169 - DNA, 25 bp, Mus musculus
tttgtccccataccagtgaggatct

SEQ ID NO: 976170 - DNA, 25 bp, Mus musculus
tttgtccccatagcagtgaggatct

SEQ ID NO: 976171 - DNA, 25 bp, Mus musculus
tttgtccccgagcagccgagctgtt

SEQ ID NO: 976172 - DNA, 25 bp, Mus musculus
tttgtccccgaggagccgagctgtt

SEQ ID NO: 976173 - DNA, 25 bp, Mus musculus
tttgtcccctaaacttagtgctgaa

SEQ ID NO: 976174 - DNA, 25 bp, Mus musculus
tttgtcccctaatcttagtgctgaa

SEQ ID NO: 976175 - DNA, 25 bp, Mus musculus
tttgtcccggaaatccagcgagatt

SEQ ID NO: 976176 - DNA, 25 bp, Mus musculus
tttgtcccggaattccagcgagatt

SEQ ID NO: 976177 - DNA, 25 bp, Mus musculus
tttgtccctcctagcctaagaaata

SEQ ID NO: 976178 - DNA, 25 bp, Mus musculus
tttgtccctccttgcctaagaaata

SEQ ID NO: 976179 - DNA, 25 bp, Mus musculus
tttgtccctgagatcgtccaaatca

SEQ ID NO: 976180 - DNA, 25 bp, Mus musculus
tttgtccctgagttcgtccaaatca

SEQ ID NO: 976181 - DNA, 25 bp, Mus musculus
tttgtccctgccaagtactgggatt

SEQ ID NO: 976182 - DNA, 25 bp, Mus musculus
tttgtccctgcctagtactgggatt

SEQ ID NO: 976183 - DNA, 25 bp, Mus musculus
tttgtcccttatacagcatagtcac

SEQ ID NO: 976184 - DNA, 25 bp, Mus musculus
tttgtcccttattcagcatagtcac

SEQ ID NO: 976185 - DNA, 25 bp, Mus musculus
tttgtcccttccctctcgtgcagtg

SEQ ID NO: 976186 - DNA, 25 bp, Mus musculus
tttgtcccttccgtctcgtgcagtg

SEQ ID NO: 976187 - DNA, 25 bp, Mus musculus
tttgtcccttttacaccaagcactg

SEQ ID NO: 976188 - DNA, 25 bp, Mus musculus
tttgtccctttttcaccaagcactg

SEQ ID NO: 976189 - DNA, 25 bp, Mus musculus
tttgtccgggttatgcagattccaa

SEQ ID NO: 976190 - DNA, 25 bp, Mus musculus
tttgtccgggttttgcagattccaa

SEQ ID NO: 976191 - DNA, 25 bp, Mus musculus
tttgtcctaattctcatgccttgag

SEQ ID NO: 976192 - DNA, 25 bp, Mus musculus
tttgtcctaattgtcatgccttgag

SEQ ID NO: 976193 - DNA, 25 bp, Mus musculus
tttgtcctaggcagggtttgaatag

SEQ ID NO: 976194 - DNA, 25 bp, Mus musculus
tttgtcctaggctgggtttgaatag

SEQ ID NO: 976195 - DNA, 25 bp, Mus musculus
tttgtcctatatcactagagccagt

SEQ ID NO: 976196 - DNA, 25 bp, Mus musculus
tttgtcctatatgactagagccagt

SEQ ID NO: 976197 - DNA, 25 bp, Mus musculus
tttgtcctatgaatcccttgacagt

SEQ ID NO: 976198 - DNA, 25 bp, Mus musculus
tttgtcctatgattcccttgacagt

SEQ ID NO: 976199 - DNA, 25 bp, Mus musculus
tttgtcctcagccaggtgatttttg

SEQ ID NO: 976200 - DNA, 25 bp, Mus musculus
tttgtcctcagcgaggtgatttttg

SEQ ID NO: 976201 - DNA, 25 bp, Mus musculus
tttgtcctcgaacgtggaaatcaaa

SEQ ID NO: 976202 - DNA, 25 bp, Mus musculus
tttgtcctcgaaggtggaaatcaaa

SEQ ID NO: 976203 - DNA, 25 bp, Mus musculus
tttgtcctcgctctagtcatcatca

SEQ ID NO: 976204 - DNA, 25 bp, Mus musculus
tttgtcctcgctgtagtcatcatca

SEQ ID NO: 976205 - DNA, 25 bp, Mus musculus
tttgtcctcggtcgttaaaactcag

SEQ ID NO: 976206 - DNA, 25 bp, Mus musculus
tttgtcctcggtggttaaaactcag

SEQ ID NO: 976207 - DNA, 25 bp, Mus musculus
tttgtcctgcataccatagttcgcg

SEQ ID NO: 976208 - DNA, 25 bp, Mus musculus
tttgtcctgcattccatagttcgcg

SEQ ID NO: 976209 - DNA, 25 bp, Mus musculus
tttgtcctgcctagagcctattaaa

SEQ ID NO: 976210 - DNA, 25 bp, Mus musculus
tttgtcctgccttgagcctattaaa

SEQ ID NO: 976211 - DNA, 25 bp, Mus musculus
tttgtcctggaaactgcattaatgg

SEQ ID NO: 976212 - DNA, 25 bp, Mus musculus
tttgtcctggaatctgcattaatgg

SEQ ID NO: 976213 - DNA, 25 bp, Mus musculus
tttgtcctggtcagtagcctgaaga

SEQ ID NO: 976214 - DNA, 25 bp, Mus musculus
tttgtcctggtctgtagcctgaaga

SEQ ID NO: 976215 - DNA, 25 bp, Mus musculus
tttgtccttaaaatcactctggttt

SEQ ID NO: 976216 - DNA, 25 bp, Mus musculus
tttgtccttaaattcactctggttt

SEQ ID NO: 976217 - DNA, 25 bp, Mus musculus
tttgtccttaacactgtgtggtttc

SEQ ID NO: 976218 - DNA, 25 bp, Mus musculus
tttgtccttaactctgtgtggtttc

SEQ ID NO: 976219 - DNA, 25 bp, Mus musculus
tttgtccttccgattccgtgaacag

SEQ ID NO: 976220 - DNA, 25 bp, Mus musculus
tttgtccttccgtttccgtgaacag

SEQ ID NO: 976221 - DNA, 25 bp, Mus musculus
tttgtccttgaacccagccatggtg

SEQ ID NO: 976222 - DNA, 25 bp, Mus musculus
tttgtccttgaagccagccatggtg

SEQ ID NO: 976223 - DNA, 25 bp, Mus musculus
tttgtccttgacaacttccaaccaa

SEQ ID NO: 976224 - DNA, 25 bp, Mus musculus
tttgtccttgactacttccaaccaa

SEQ ID NO: 976225 - DNA, 25 bp, Mus musculus
tttgtccttgtacatacttgactca

SEQ ID NO: 976226 - DNA, 25 bp, Mus musculus
tttgtccttgtagatacttgactca

SEQ ID NO: 976227 - DNA, 25 bp, Mus musculus
tttgtccttgttccctgttgccaat

SEQ ID NO: 976228 - DNA, 25 bp, Mus musculus
tttgtccttgttgcctgttgccaat

SEQ ID NO: 976229 - DNA, 25 bp, Mus musculus
tttgtcctttgcagcccattgttct

SEQ ID NO: 976230 - DNA, 25 bp, Mus musculus
tttgtcctttgctgcccattgttct

SEQ ID NO: 976231 - DNA, 25 bp, Mus musculus
tttgtccttttgatactgacacaat

SEQ ID NO: 976232 - DNA, 25 bp, Mus musculus
tttgtccttttgttactgacacaat

SEQ ID NO: 976233 - DNA, 25 bp, Mus musculus
tttgtcgaagctccagattcaccag

SEQ ID NO: 976234 - DNA, 25 bp, Mus musculus
tttgtcgaagctgcagattcaccag

SEQ ID NO: 976235 - DNA, 25 bp, Mus musculus
tttgtcgagagcagccttcatccat

SEQ ID NO: 976236 - DNA, 25 bp, Mus musculus
tttgtcgagagctgccttcatccat

SEQ ID NO: 976237 - DNA, 25 bp, Mus musculus
tttgtcgtctgcaggactccctact

SEQ ID NO: 976238 - DNA, 25 bp, Mus musculus
tttgtcgtctgctggactccctact

SEQ ID NO: 976239 - DNA, 25 bp, Mus musculus
tttgtcgttcacagccatcaatctt

SEQ ID NO: 976240 - DNA, 25 bp, Mus musculus
tttgtcgttcactgccatcaatctt

SEQ ID NO: 976241 - DNA, 25 bp, Mus musculus
tttgtcgttcagatcagactaattg

SEQ ID NO: 976242 - DNA, 25 bp, Mus musculus
tttgtcgttcagttcagactaattg

SEQ ID NO: 976243 - DNA, 25 bp, Mus musculus
tttgtcgttgttatccatgaggctt

SEQ ID NO: 976244 - DNA, 25 bp, Mus musculus
tttgtcgttgttttccatgaggctt

SEQ ID NO: 976245 - DNA, 25 bp, Mus musculus
tttgtctaaacgaacctggtctggg

SEQ ID NO: 976246 - DNA, 25 bp, Mus musculus
tttgtctaaacgtacctggtctggg

SEQ ID NO: 976247 - DNA, 25 bp, Mus musculus
tttgtctaatgaatacactgttctc

SEQ ID NO: 976248 - DNA, 25 bp, Mus musculus
tttgtctaatgattacactgttctc

SEQ ID NO: 976249 - DNA, 25 bp, Mus musculus
tttgtctacagacgatgcttcagca

SEQ ID NO: 976250 - DNA, 25 bp, Mus musculus
tttgtctacagaggatgcttcagca

SEQ ID NO: 976251 - DNA, 25 bp, Mus musculus
tttgtctaccttacagctgtttctc

SEQ ID NO: 976252 - DNA, 25 bp, Mus musculus
tttgtctacctttcagctgtttctc

SEQ ID NO: 976253 - DNA, 25 bp, Mus musculus
tttgtctattaaaccattggtggac

SEQ ID NO: 976254 - DNA, 25 bp, Mus musculus
tttgtctattaatccattggtggac

SEQ ID NO: 976255 - DNA, 25 bp, Mus musculus
tttgtctattttaatcctgctattc

SEQ ID NO: 976256 - DNA, 25 bp, Mus musculus
tttgtctatttttatcctgctattc

SEQ ID NO: 976257 - DNA, 25 bp, Mus musculus
tttgtctcacggatcctggttaaga

SEQ ID NO: 976258 - DNA, 25 bp, Mus musculus
tttgtctcacggttcctggttaaga

SEQ ID NO: 976259 - DNA, 25 bp, Mus musculus
tttgtctccactatatctcagttga

SEQ ID NO: 976260 - DNA, 25 bp, Mus musculus
tttgtctccactttatctcagttga

SEQ ID NO: 976261 - DNA, 25 bp, Mus musculus
tttgtctccagtcattgaatcccag

SEQ ID NO: 976262 - DNA, 25 bp, Mus musculus
tttgtctccagtgattgaatcccag

SEQ ID NO: 976263 - DNA, 25 bp, Mus musculus
tttgtctccattcttgatcttgttc

SEQ ID NO: 976264 - DNA, 25 bp, Mus musculus
tttgtctccattgttgatcttgttc

SEQ ID NO: 976265 - DNA, 25 bp, Mus musculus
tttgtctcccctagctttaaataat

SEQ ID NO: 976266 - DNA, 25 bp, Mus musculus
tttgtctccccttgctttaaataat

SEQ ID NO: 976267 - DNA, 25 bp, Mus musculus
tttgtctcctgtaaatagcggctcc

SEQ ID NO: 976268 - DNA, 25 bp, Mus musculus
tttgtctcctgttaatagcggctcc

SEQ ID NO: 976269 - DNA, 25 bp, Mus musculus
tttgtctcggttcacgtggcccact

SEQ ID NO: 976270 - DNA, 25 bp, Mus musculus
tttgtctcggttgacgtggcccact

SEQ ID NO: 976271 - DNA, 25 bp, Mus musculus
tttgtctcgtataagattgtaagct

SEQ ID NO: 976272 - DNA, 25 bp, Mus musculus
tttgtctcgtattagattgtaagct

SEQ ID NO: 976273 - DNA, 25 bp, Mus musculus
tttgtctctagcagtccactaggaa

SEQ ID NO: 976274 - DNA, 25 bp, Mus musculus
tttgtctctagctgtccactaggaa

SEQ ID NO: 976275 - DNA, 25 bp, Mus musculus
tttgtctctcaaagtgttggctgta

SEQ ID NO: 976276 - DNA, 25 bp, Mus musculus
tttgtctctcaatgtgttggctgta

SEQ ID NO: 976277 - DNA, 25 bp, Mus musculus
tttgtctctctgctcatgtgaagtc

SEQ ID NO: 976278 - DNA, 25 bp, Mus musculus
tttgtctctctggtcatgtgaagtc

SEQ ID NO: 976279 - DNA, 25 bp, Mus musculus
tttgtctctggcatacatggttttc

SEQ ID NO: 976280 - DNA, 25 bp, Mus musculus
tttgtctctggcttacatggttttc

SEQ ID NO: 976281 - DNA, 25 bp, Mus musculus
tttgtctctgtacctagcgtgggca

SEQ ID NO: 976282 - DNA, 25 bp, Mus musculus
tttgtctctgtagctagcgtgggca

SEQ ID NO: 976283 - DNA, 25 bp, Mus musculus
tttgtctcttaaatccctcacctct

SEQ ID NO: 976284 - DNA, 25 bp, Mus musculus
tttgtctcttaattccctcacctct

SEQ ID NO: 976285 - DNA, 25 bp, Mus musculus
tttgtctcttcaccaaaaggtacag

SEQ ID NO: 976286 - DNA, 25 bp, Mus musculus
tttgtctcttcagcaaaaggtacag

SEQ ID NO: 976287 - DNA, 25 bp, Mus musculus
tttgtctcttgacactctaactcca

SEQ ID NO: 976288 - DNA, 25 bp, Mus musculus
tttgtctcttgagactctaactcca

SEQ ID NO: 976289 - DNA, 25 bp, Mus musculus
tttgtctcttttctttgcctcaggc

SEQ ID NO: 976290 - DNA, 25 bp, Mus musculus
tttgtctcttttgtttgcctcaggc

SEQ ID NO: 976291 - DNA, 25 bp, Mus musculus
tttgtctgagacaaggcctctgtat

SEQ ID NO: 976292 - DNA, 25 bp, Mus musculus
tttgtctgagactaggcctctgtat

SEQ ID NO: 976293 - DNA, 25 bp, Mus musculus
tttgtctgagagcactatatagtag

SEQ ID NO: 976294 - DNA, 25 bp, Mus musculus
tttgtctgagaggactatatagtag

SEQ ID NO: 976295 - DNA, 25 bp, Mus musculus
tttgtctgcactagggttcacttga

SEQ ID NO: 976296 - DNA, 25 bp, Mus musculus
tttgtctgcacttgggttcacttga

SEQ ID NO: 976297 - DNA, 25 bp, Mus musculus
tttgtctgcatgagcatctatgcac

SEQ ID NO: 976298 - DNA, 25 bp, Mus musculus
tttgtctgcatgtgcatctatgcac

SEQ ID NO: 976299 - DNA, 25 bp, Mus musculus
tttgtctgcgtcatcgtcggagggt

SEQ ID NO: 976300 - DNA, 25 bp, Mus musculus
tttgtctgcgtcttcgtcggagggt

SEQ ID NO: 976301 - DNA, 25 bp, Mus musculus
tttgtctgctaaaactggccatgaa

SEQ ID NO: 976302 - DNA, 25 bp, Mus musculus
tttgtctgctaatactggccatgaa

SEQ ID NO: 976303 - DNA, 25 bp, Mus musculus
tttgtctgctttctcgtttccttac

SEQ ID NO: 976304 - DNA, 25 bp, Mus musculus
tttgtctgctttgtcgtttccttac

SEQ ID NO: 976305 - DNA, 25 bp, Mus musculus
tttgtctggatcagtggtcctcctg

SEQ ID NO: 976306 - DNA, 25 bp, Mus musculus
tttgtctggatctgtggtcctcctg

SEQ ID NO: 976307 - DNA, 25 bp, Mus musculus
tttgtctggtttaccagaggccagg

SEQ ID NO: 976308 - DNA, 25 bp, Mus musculus
tttgtctggttttccagaggccagg

SEQ ID NO: 976309 - DNA, 25 bp, Mus musculus
tttgtctgtgctcatgttcgtggga

SEQ ID NO: 976310 - DNA, 25 bp, Mus musculus
tttgtctgtgctgatgttcgtggga

SEQ ID NO: 976311 - DNA, 25 bp, Mus musculus
tttgtctgtgtgatagtttttcctt

SEQ ID NO: 976312 - DNA, 25 bp, Mus musculus
tttgtctgtgtgttagtttttcctt

SEQ ID NO: 976313 - DNA, 25 bp, Mus musculus
tttgtctgttaacccatcctgttgg

SEQ ID NO: 976314 - DNA, 25 bp, Mus musculus
tttgtctgttaagccatcctgttgg

SEQ ID NO: 976315 - DNA, 25 bp, Mus musculus
tttgtctgttctacaatgaaggatc

SEQ ID NO: 976316 - DNA, 25 bp, Mus musculus
tttgtctgttcttcaatgaaggatc

SEQ ID NO: 976317 - DNA, 25 bp, Mus musculus
tttgtcttcatcacacctttcatca

SEQ ID NO: 976318 - DNA, 25 bp, Mus musculus
tttgtcttcatctcacctttcatca

SEQ ID NO: 976319 - DNA, 25 bp, Mus musculus
tttgtcttctatacgtgtaaataag

SEQ ID NO: 976320 - DNA, 25 bp, Mus musculus
tttgtcttctattcgtgtaaataag

SEQ ID NO: 976321 - DNA, 25 bp, Mus musculus
tttgtcttctggacacaggcaaaca

SEQ ID NO: 976322 - DNA, 25 bp, Mus musculus
tttgtcttctggtcacaggcaaaca

SEQ ID NO: 976323 - DNA, 25 bp, Mus musculus
tttgtcttcttcctgctccatattg

SEQ ID NO: 976324 - DNA, 25 bp, Mus musculus
tttgtcttcttcgtgctccatattg

SEQ ID NO: 976325 - DNA, 25 bp, Mus musculus
tttgtcttcttgacctctcagggtg

SEQ ID NO: 976326 - DNA, 25 bp, Mus musculus
tttgtcttcttgtcctctcagggtg

SEQ ID NO: 976327 - DNA, 25 bp, Mus musculus
tttgtcttgagcaagcaagcctcta

SEQ ID NO: 976328 - DNA, 25 bp, Mus musculus
tttgtcttgagctagcaagcctcta

SEQ ID NO: 976329 - DNA, 25 bp, Mus musculus
tttgtcttgcagcaagaatgaaata

SEQ ID NO: 976330 - DNA, 25 bp, Mus musculus
tttgtcttgcaggaagaatgaaata

SEQ ID NO: 976331 - DNA, 25 bp, Mus musculus
tttgtcttgtacatctgtgttcatt

SEQ ID NO: 976332 - DNA, 25 bp, Mus musculus
tttgtcttgtacttctgtgttcatt

SEQ ID NO: 976333 - DNA, 25 bp, Mus musculus
tttgtcttgttcaccccttactgta

SEQ ID NO: 976334 - DNA, 25 bp, Mus musculus
tttgtcttgttctccccttactgta

SEQ ID NO: 976335 - DNA, 25 bp, Mus musculus
tttgtctttcacagtcttccgcttg

SEQ ID NO: 976336 - DNA, 25 bp, Mus musculus
tttgtctttcactgtcttccgcttg

SEQ ID NO: 976337 - DNA, 25 bp, Mus musculus
tttgtctttctgactagcatgctac

SEQ ID NO: 976338 - DNA, 25 bp, Mus musculus
tttgtctttctgtctagcatgctac

SEQ ID NO: 976339 - DNA, 25 bp, Mus musculus
tttgtcttttctagtctattctttt

SEQ ID NO: 976340 - DNA, 25 bp, Mus musculus
tttgtcttttcttgtctattctttt

SEQ ID NO: 976341 - DNA, 25 bp, Mus musculus
tttgtgaaaactcagcattaaaacc

SEQ ID NO: 976342 - DNA, 25 bp, Mus musculus
tttgtgaaaactgagcattaaaacc

SEQ ID NO: 976343 - DNA, 25 bp, Mus musculus
tttgtgaaaatgaacatacccagta

SEQ ID NO: 976344 - DNA, 25 bp, Mus musculus
tttgtgaaaatgtacatacccagta

SEQ ID NO: 976345 - DNA, 25 bp, Mus musculus
tttgtgaacaagctagaccccagca

SEQ ID NO: 976346 - DNA, 25 bp, Mus musculus
tttgtgaacaaggtagaccccagca

SEQ ID NO: 976347 - DNA, 25 bp, Mus musculus
tttgtgaacaccagcacatacctcc

SEQ ID NO: 976348 - DNA, 25 bp, Mus musculus
tttgtgaacacctgcacatacctcc

SEQ ID NO: 976349 - DNA, 25 bp, Mus musculus
tttgtgaacttccaaatcgatcgga

SEQ ID NO: 976350 - DNA, 25 bp, Mus musculus
tttgtgaacttcgaaatcgatcgga

SEQ ID NO: 976351 - DNA, 25 bp, Mus musculus
tttgtgaagcagacagcgctcgctc

SEQ ID NO: 976352 - DNA, 25 bp, Mus musculus
tttgtgaagcagtcagcgctcgctc

SEQ ID NO: 976353 - DNA, 25 bp, Mus musculus
tttgtgaagtcacccttcgtcacta

SEQ ID NO: 976354 - DNA, 25 bp, Mus musculus
tttgtgaagtcagccttcgtcacta

SEQ ID NO: 976355 - DNA, 25 bp, Mus musculus
tttgtgaataaaccgattgtgctag

SEQ ID NO: 976356 - DNA, 25 bp, Mus musculus
tttgtgaataaagcgattgtgctag

SEQ ID NO: 976357 - DNA, 25 bp, Mus musculus
tttgtgaatggcatactttggtttt

SEQ ID NO: 976358 - DNA, 25 bp, Mus musculus
tttgtgaatggcttactttggtttt

SEQ ID NO: 976359 - DNA, 25 bp, Mus musculus
tttgtgaatgggaccttgacaggca

SEQ ID NO: 976360 - DNA, 25 bp, Mus musculus
tttgtgaatgggtccttgacaggca

SEQ ID NO: 976361 - DNA, 25 bp, Mus musculus
tttgtgacactgcaagccttggctc

SEQ ID NO: 976362 - DNA, 25 bp, Mus musculus
tttgtgacactggaagccttggctc

SEQ ID NO: 976363 - DNA, 25 bp, Mus musculus
tttgtgaccggccttggatcctgga

SEQ ID NO: 976364 - DNA, 25 bp, Mus musculus
tttgtgaccggcgttggatcctgga

SEQ ID NO: 976365 - DNA, 25 bp, Mus musculus
tttgtgacgggcatccggattcaga

SEQ ID NO: 976366 - DNA, 25 bp, Mus musculus
tttgtgacgggcttccggattcaga

SEQ ID NO: 976367 - DNA, 25 bp, Mus musculus
tttgtgactatactgtacctgtctt

SEQ ID NO: 976368 - DNA, 25 bp, Mus musculus
tttgtgactatagtgtacctgtctt

SEQ ID NO: 976369 - DNA, 25 bp, Mus musculus
tttgtgactgtcaaacccactagtt

SEQ ID NO: 976370 - DNA, 25 bp, Mus musculus
tttgtgactgtctaacccactagtt

SEQ ID NO: 976371 - DNA, 25 bp, Mus musculus
tttgtgactgttctcagcgagctcc

SEQ ID NO: 976372 - DNA, 25 bp, Mus musculus
tttgtgactgttgtcagcgagctcc

SEQ ID NO: 976373 - DNA, 25 bp, Mus musculus
tttgtgacttttccatttaaccctg

SEQ ID NO: 976374 - DNA, 25 bp, Mus musculus
tttgtgacttttgcatttaaccctg

SEQ ID NO: 976375 - DNA, 25 bp, Mus musculus
tttgtgagacaccagctacctctga

SEQ ID NO: 976376 - DNA, 25 bp, Mus musculus
tttgtgagacacgagctacctctga

SEQ ID NO: 976377 - DNA, 25 bp, Mus musculus
tttgtgagatgtcctttcccactcc

SEQ ID NO: 976378 - DNA, 25 bp, Mus musculus
tttgtgagatgtgctttcccactcc

SEQ ID NO: 976379 - DNA, 25 bp, Mus musculus
tttgtgagcattactgaccttcttt

SEQ ID NO: 976380 - DNA, 25 bp, Mus musculus
tttgtgagcatttctgaccttcttt

SEQ ID NO: 976381 - DNA, 25 bp, Mus musculus
tttgtgagccttaggttgtcagtgg

SEQ ID NO: 976382 - DNA, 25 bp, Mus musculus
tttgtgagccttatcgggagtgtct

SEQ ID NO: 976383 - DNA, 25 bp, Mus musculus
tttgtgagcctttggttgtcagtgg

SEQ ID NO: 976384 - DNA, 25 bp, Mus musculus
tttgtgagccttttcgggagtgtct

SEQ ID NO: 976385 - DNA, 25 bp, Mus musculus
tttgtgaggagacaactctgccaga

SEQ ID NO: 976386 - DNA, 25 bp, Mus musculus
tttgtgaggagagaactctgccaga

SEQ ID NO: 976387 - DNA, 25 bp, Mus musculus
tttgtgaggcaaagtcttaccatgt

SEQ ID NO: 976388 - DNA, 25 bp, Mus musculus
tttgtgaggcaatgtcttaccatgt

SEQ ID NO: 976389 - DNA, 25 bp, Mus musculus
tttgtgagtaaaagccattcgcgta

SEQ ID NO: 976390 - DNA, 25 bp, Mus musculus
tttgtgagtaaatgccattcgcgta

SEQ ID NO: 976391 - DNA, 25 bp, Mus musculus
tttgtgagtcagctgtttctcataa

SEQ ID NO: 976392 - DNA, 25 bp, Mus musculus
tttgtgagtcaggtgtttctcataa

SEQ ID NO: 976393 - DNA, 25 bp, Mus musculus
tttgtgagtggcctctgctaatgct

SEQ ID NO: 976394 - DNA, 25 bp, Mus musculus
tttgtgagtggcgtctgctaatgct

SEQ ID NO: 976395 - DNA, 25 bp, Mus musculus
tttgtgagtggtccctgagcactta

SEQ ID NO: 976396 - DNA, 25 bp, Mus musculus
tttgtgagtggtgcctgagcactta

SEQ ID NO: 976397 - DNA, 25 bp, Mus musculus
tttgtgataatgaagtccctccaaa

SEQ ID NO: 976398 - DNA, 25 bp, Mus musculus
tttgtgataatgtagtccctccaaa

SEQ ID NO: 976399 - DNA, 25 bp, Mus musculus
tttgtgatatctcagggaccgccca

SEQ ID NO: 976400 - DNA, 25 bp, Mus musculus
tttgtgatatctgagggaccgccca

SEQ ID NO: 976401 - DNA, 25 bp, Mus musculus
tttgtgatcagtctttctcataatg

SEQ ID NO: 976402 - DNA, 25 bp, Mus musculus
tttgtgatcagtgtttctcataatg

SEQ ID NO: 976403 - DNA, 25 bp, Mus musculus
tttgtgatctagactgcccctttct

SEQ ID NO: 976404 - DNA, 25 bp, Mus musculus
tttgtgatctagtctgcccctttct

SEQ ID NO: 976405 - DNA, 25 bp, Mus musculus
tttgtgatctccagccagactttgg

SEQ ID NO: 976406 - DNA, 25 bp, Mus musculus
tttgtgatctcctgccagactttgg

SEQ ID NO: 976407 - DNA, 25 bp, Mus musculus
tttgtgatctctatgcctgtatgca

SEQ ID NO: 976408 - DNA, 25 bp, Mus musculus
tttgtgatctctttgcctgtatgca

SEQ ID NO: 976409 - DNA, 25 bp, Mus musculus
tttgtgatgattagtcagcctgtac

SEQ ID NO: 976410 - DNA, 25 bp, Mus musculus
tttgtgatgatttgtcagcctgtac

SEQ ID NO: 976411 - DNA, 25 bp, Mus musculus
tttgtgatgcaaatctaggcagctg

SEQ ID NO: 976412 - DNA, 25 bp, Mus musculus
tttgtgatgcaattctaggcagctg

SEQ ID NO: 976413 - DNA, 25 bp, Mus musculus
tttgtgatgcctctaccttcctgat

SEQ ID NO: 976414 - DNA, 25 bp, Mus musculus
tttgtgatgcctgtaccttcctgat

SEQ ID NO: 976415 - DNA, 25 bp, Mus musculus
tttgtgatggtgctccacctagcca

SEQ ID NO: 976416 - DNA, 25 bp, Mus musculus
tttgtgatggtggtccacctagcca

SEQ ID NO: 976417 - DNA, 25 bp, Mus musculus
tttgtgattgctagggtagaaaatg

SEQ ID NO: 976418 - DNA, 25 bp, Mus musculus
tttgtgattgcttgggtagaaaatg

SEQ ID NO: 976419 - DNA, 25 bp, Mus musculus
tttgtgcaaactacctgtaaccctg

SEQ ID NO: 976420 - DNA, 25 bp, Mus musculus
tttgtgcaaacttcctgtaaccctg

SEQ ID NO: 976421 - DNA, 25 bp, Mus musculus
tttgtgcaagcacctcccggactgg

SEQ ID NO: 976422 - DNA, 25 bp, Mus musculus
tttgtgcaagcagctcccggactgg

SEQ ID NO: 976423 - DNA, 25 bp, Mus musculus
tttgtgcacagaccgcctattcagc

SEQ ID NO: 976424 - DNA, 25 bp, Mus musculus
tttgtgcacagagcgcctattcagc

SEQ ID NO: 976425 - DNA, 25 bp, Mus musculus
tttgtgcaccctacctaagataagc

SEQ ID NO: 976426 - DNA, 25 bp, Mus musculus
tttgtgcacccttcctaagataagc

SEQ ID NO: 976427 - DNA, 25 bp, Mus musculus
tttgtgcagatgatagaaatacata

SEQ ID NO: 976428 - DNA, 25 bp, Mus musculus
tttgtgcagatgttagaaatacata

SEQ ID NO: 976429 - DNA, 25 bp, Mus musculus
tttgtgcagcaaccctacggagagt

SEQ ID NO: 976430 - DNA, 25 bp, Mus musculus
tttgtgcagcaagcctacggagagt

SEQ ID NO: 976431 - DNA, 25 bp, Mus musculus
tttgtgcaggccaggcagaatctta

SEQ ID NO: 976432 - DNA, 25 bp, Mus musculus
tttgtgcaggcctggcagaatctta

SEQ ID NO: 976433 - DNA, 25 bp, Mus musculus
tttgtgcatataaacctacagttaa

SEQ ID NO: 976434 - DNA, 25 bp, Mus musculus
tttgtgcatatatacctacagttaa

SEQ ID NO: 976435 - DNA, 25 bp, Mus musculus
tttgtgcatccactctgagagccac

SEQ ID NO: 976436 - DNA, 25 bp, Mus musculus
tttgtgcatccagtctgagagccac

SEQ ID NO: 976437 - DNA, 25 bp, Mus musculus
tttgtgcatctactgtggcctttca

SEQ ID NO: 976438 - DNA, 25 bp, Mus musculus
tttgtgcatctagtgtggcctttca

SEQ ID NO: 976439 - DNA, 25 bp, Mus musculus
tttgtgcatgatcagagccgccagc

SEQ ID NO: 976440 - DNA, 25 bp, Mus musculus
tttgtgcatgatgagagccgccagc

SEQ ID NO: 976441 - DNA, 25 bp, Mus musculus
tttgtgcatggtactgtgtgtatac

SEQ ID NO: 976442 - DNA, 25 bp, Mus musculus
tttgtgcatggttctgtgtgtatac

SEQ ID NO: 976443 - DNA, 25 bp, Mus musculus
tttgtgcatgttatctgctgggtgg

SEQ ID NO: 976444 - DNA, 25 bp, Mus musculus
tttgtgcatgttttctgctgggtgg

SEQ ID NO: 976445 - DNA, 25 bp, Mus musculus
tttgtgccacctctgaagcaagttt

SEQ ID NO: 976446 - DNA, 25 bp, Mus musculus
tttgtgccacctgtgaagcaagttt

SEQ ID NO: 976447 - DNA, 25 bp, Mus musculus
tttgtgccatagaaagcccactctt

SEQ ID NO: 976448 - DNA, 25 bp, Mus musculus
tttgtgccatagtaagcccactctt

SEQ ID NO: 976449 - DNA, 25 bp, Mus musculus
tttgtgccatccagcaaggtgacag

SEQ ID NO: 976450 - DNA, 25 bp, Mus musculus
tttgtgccatcctgcaaggtgacag

SEQ ID NO: 976451 - DNA, 25 bp, Mus musculus
tttgtgcccattatcaggctccagt

SEQ ID NO: 976452 - DNA, 25 bp, Mus musculus
tttgtgcccattttcaggctccagt

SEQ ID NO: 976453 - DNA, 25 bp, Mus musculus
tttgtgccctaaaagccactgctag

SEQ ID NO: 976454 - DNA, 25 bp, Mus musculus
tttgtgccctaatagccactgctag

SEQ ID NO: 976455 - DNA, 25 bp, Mus musculus
tttgtgcctaaacgccttcccttgg

SEQ ID NO: 976456 - DNA, 25 bp, Mus musculus
tttgtgcctaaaggccttcccttgg

SEQ ID NO: 976457 - DNA, 25 bp, Mus musculus
tttgtgcctaatatgtcctgtccta

SEQ ID NO: 976458 - DNA, 25 bp, Mus musculus
tttgtgcctaatttgtcctgtccta

SEQ ID NO: 976459 - DNA, 25 bp, Mus musculus
tttgtgcctcaaatcctccatttgt

SEQ ID NO: 976460 - DNA, 25 bp, Mus musculus
tttgtgcctcaaatctgcaaccttc

SEQ ID NO: 976461 - DNA, 25 bp, Mus musculus
tttgtgcctcaattcctccatttgt

SEQ ID NO: 976462 - DNA, 25 bp, Mus musculus
tttgtgcctcaattctgcaaccttc

SEQ ID NO: 976463 - DNA, 25 bp, Mus musculus
tttgtgcctcctctgttgctaagaa

SEQ ID NO: 976464 - DNA, 25 bp, Mus musculus
tttgtgcctcctgtgttgctaagaa

SEQ ID NO: 976465 - DNA, 25 bp, Mus musculus
tttgtgcctctgacctaccagaatg

SEQ ID NO: 976466 - DNA, 25 bp, Mus musculus
tttgtgcctctgtcctaccagaatg

SEQ ID NO: 976467 - DNA, 25 bp, Mus musculus
tttgtgcctgacacatatagtccat

SEQ ID NO: 976468 - DNA, 25 bp, Mus musculus
tttgtgcctgactcatatagtccat

SEQ ID NO: 976469 - DNA, 25 bp, Mus musculus
tttgtgcctgttagactgtccgtag

SEQ ID NO: 976470 - DNA, 25 bp, Mus musculus
tttgtgcctgttcagtaagacccat

SEQ ID NO: 976471 - DNA, 25 bp, Mus musculus
tttgtgcctgttgagtaagacccat

SEQ ID NO: 976472 - DNA, 25 bp, Mus musculus
tttgtgcctgtttgactgtccgtag

SEQ ID NO: 976473 - DNA, 25 bp, Mus musculus
tttgtgccttccctggtcattgtac

SEQ ID NO: 976474 - DNA, 25 bp, Mus musculus
tttgtgccttccgtggtcattgtac

SEQ ID NO: 976475 - DNA, 25 bp, Mus musculus
tttgtgccttctatagcaaagagaa

SEQ ID NO: 976476 - DNA, 25 bp, Mus musculus
tttgtgccttctttagcaaagagaa

SEQ ID NO: 976477 - DNA, 25 bp, Mus musculus
tttgtgcctttgatatcagctgacc

SEQ ID NO: 976478 - DNA, 25 bp, Mus musculus
tttgtgcctttgttatcagctgacc

SEQ ID NO: 976479 - DNA, 25 bp, Mus musculus
tttgtgcgtctgaagtgtcggagtc

SEQ ID NO: 976480 - DNA, 25 bp, Mus musculus
tttgtgcgtctgtagtgtcggagtc

SEQ ID NO: 976481 - DNA, 25 bp, Mus musculus
tttgtgctacttcatctgttttggt

SEQ ID NO: 976482 - DNA, 25 bp, Mus musculus
tttgtgctacttgatctgttttggt

SEQ ID NO: 976483 - DNA, 25 bp, Mus musculus
tttgtgctcaaaactgtgtaactgt

SEQ ID NO: 976484 - DNA, 25 bp, Mus musculus
tttgtgctcaaatctgtgtaactgt

SEQ ID NO: 976485 - DNA, 25 bp, Mus musculus
tttgtgctcaaccttgccatggcag

SEQ ID NO: 976486 - DNA, 25 bp, Mus musculus
tttgtgctcaacgttgccatggcag

SEQ ID NO: 976487 - DNA, 25 bp, Mus musculus
tttgtgctccggctcactgactgcc

SEQ ID NO: 976488 - DNA, 25 bp, Mus musculus
tttgtgctccgggtcactgactgcc

SEQ ID NO: 976489 - DNA, 25 bp, Mus musculus
tttgtgctccttaacaacggcgaga

SEQ ID NO: 976490 - DNA, 25 bp, Mus musculus
tttgtgctcctttacaacggcgaga

SEQ ID NO: 976491 - DNA, 25 bp, Mus musculus
tttgtgctcttacaacccttatgca

SEQ ID NO: 976492 - DNA, 25 bp, Mus musculus
tttgtgctcttagaacccttatgca

SEQ ID NO: 976493 - DNA, 25 bp, Mus musculus
tttgtgctgagactgctgagactgc

SEQ ID NO: 976494 - DNA, 25 bp, Mus musculus
tttgtgctgagagtgctgagactgc

SEQ ID NO: 976495 - DNA, 25 bp, Mus musculus
tttgtgctgcacagaagtgcttgga

SEQ ID NO: 976496 - DNA, 25 bp, Mus musculus
tttgtgctgcactgaagtgcttgga

SEQ ID NO: 976497 - DNA, 25 bp, Mus musculus
tttgtgctgccccttacagagaggc

SEQ ID NO: 976498 - DNA, 25 bp, Mus musculus
tttgtgctgcccgttacagagaggc

SEQ ID NO: 976499 - DNA, 25 bp, Mus musculus
tttgtgctgctaccaacagtatatt

SEQ ID NO: 976500 - DNA, 25 bp, Mus musculus
tttgtgctgctagcaacagtatatt

SEQ ID NO: 976501 - DNA, 25 bp, Mus musculus
tttgtgctggctcttcccggcgtag

SEQ ID NO: 976502 - DNA, 25 bp, Mus musculus
tttgtgctggctgttcccggcgtag

SEQ ID NO: 976503 - DNA, 25 bp, Mus musculus
tttgtgctggtgaagtgccccaatc

SEQ ID NO: 976504 - DNA, 25 bp, Mus musculus
tttgtgctggtgtagtgccccaatc

SEQ ID NO: 976505 - DNA, 25 bp, Mus musculus
tttgtgctgtctactccaaggaagt

SEQ ID NO: 976506 - DNA, 25 bp, Mus musculus
tttgtgctgtcttctccaaggaagt

SEQ ID NO: 976507 - DNA, 25 bp, Mus musculus
tttgtgcttagcctggatggtgaaa

SEQ ID NO: 976508 - DNA, 25 bp, Mus musculus
tttgtgcttagcgtggatggtgaaa

SEQ ID NO: 976509 - DNA, 25 bp, Mus musculus
tttgtgcttcagactgtcttttttg

SEQ ID NO: 976510 - DNA, 25 bp, Mus musculus
tttgtgcttcagtctgtcttttttg

SEQ ID NO: 976511 - DNA, 25 bp, Mus musculus
tttgtgcttcgcatgaacagggcca

SEQ ID NO: 976512 - DNA, 25 bp, Mus musculus
tttgtgcttcgcttgaacagggcca

SEQ ID NO: 976513 - DNA, 25 bp, Mus musculus
tttgtgcttcttagtggcttcgcca

SEQ ID NO: 976514 - DNA, 25 bp, Mus musculus
tttgtgcttctttgtggcttcgcca

SEQ ID NO: 976515 - DNA, 25 bp, Mus musculus
tttgtgcttgacagctgaccaccag

SEQ ID NO: 976516 - DNA, 25 bp, Mus musculus
tttgtgcttgactgctgaccaccag

SEQ ID NO: 976517 - DNA, 25 bp, Mus musculus
tttgtgcttgtcattcttctggtgt

SEQ ID NO: 976518 - DNA, 25 bp, Mus musculus
tttgtgcttgtctttcttctggtgt

SEQ ID NO: 976519 - DNA, 25 bp, Mus musculus
tttgtggaaaccagctgtgctggca

SEQ ID NO: 976520 - DNA, 25 bp, Mus musculus
tttgtggaaacctgctgtgctggca

SEQ ID NO: 976521 - DNA, 25 bp, Mus musculus
tttgtggaactgatgggccctaaac

SEQ ID NO: 976522 - DNA, 25 bp, Mus musculus
tttgtggaactgcagtccacgccct

SEQ ID NO: 976523 - DNA, 25 bp, Mus musculus
tttgtggaactggagtccacgccct

SEQ ID NO: 976524 - DNA, 25 bp, Mus musculus
tttgtggaactgttgggccctaaac

SEQ ID NO: 976525 - DNA, 25 bp, Mus musculus
tttgtggaatataactgctgccctg

SEQ ID NO: 976526 - DNA, 25 bp, Mus musculus
tttgtggaatattactgctgccctg

SEQ ID NO: 976527 - DNA, 25 bp, Mus musculus
tttgtggaatccatgagtgtcatac

SEQ ID NO: 976528 - DNA, 25 bp, Mus musculus
tttgtggaatccttgagtgtcatac

SEQ ID NO: 976529 - DNA, 25 bp, Mus musculus
tttgtggacacaacagggcattttt

SEQ ID NO: 976530 - DNA, 25 bp, Mus musculus
tttgtggacacatcagggcattttt

SEQ ID NO: 976531 - DNA, 25 bp, Mus musculus
tttgtggaccagcttggtcttgaac

SEQ ID NO: 976532 - DNA, 25 bp, Mus musculus
tttgtggaccaggttggtcttgaac

SEQ ID NO: 976533 - DNA, 25 bp, Mus musculus
tttgtggaccctcctgttcaaagct

SEQ ID NO: 976534 - DNA, 25 bp, Mus musculus
tttgtggaccctgctgttcaaagct

SEQ ID NO: 976535 - DNA, 25 bp, Mus musculus
tttgtggacctgaacgtgccgcgga

SEQ ID NO: 976536 - DNA, 25 bp, Mus musculus
tttgtggacctgtacgtgccgcgga

SEQ ID NO: 976537 - DNA, 25 bp, Mus musculus
tttgtggacgataccccagagggat

SEQ ID NO: 976538 - DNA, 25 bp, Mus musculus
tttgtggacgattccccagagggat

SEQ ID NO: 976539 - DNA, 25 bp, Mus musculus
tttgtggagcccagccggcagtttg

SEQ ID NO: 976540 - DNA, 25 bp, Mus musculus
tttgtggagccctgccggcagtttg

SEQ ID NO: 976541 - DNA, 25 bp, Mus musculus
tttgtggagcgcagttcaatcggcc

SEQ ID NO: 976542 - DNA, 25 bp, Mus musculus
tttgtggagcgctgttcaatcggcc

SEQ ID NO: 976543 - DNA, 25 bp, Mus musculus
tttgtggattccacaccaccatgct

SEQ ID NO: 976544 - DNA, 25 bp, Mus musculus
tttgtggattcctcaccaccatgct

SEQ ID NO: 976545 - DNA, 25 bp, Mus musculus
tttgtggcaactaaacgcggcatcc

SEQ ID NO: 976546 - DNA, 25 bp, Mus musculus
tttgtggcaacttaacgcggcatcc

SEQ ID NO: 976547 - DNA, 25 bp, Mus musculus
tttgtggcagccacagcatctgaaa

SEQ ID NO: 976548 - DNA, 25 bp, Mus musculus
tttgtggcagcctcagcatctgaaa

SEQ ID NO: 976549 - DNA, 25 bp, Mus musculus
tttgtggcagtgactctcctagctg

SEQ ID NO: 976550 - DNA, 25 bp, Mus musculus
tttgtggcagtgtctctcctagctg

SEQ ID NO: 976551 - DNA, 25 bp, Mus musculus
tttgtggccaggaaacagctgcttc

SEQ ID NO: 976552 - DNA, 25 bp, Mus musculus
tttgtggccaggtaacagctgcttc

SEQ ID NO: 976553 - DNA, 25 bp, Mus musculus
tttgtggccataaggtgtcagatga

SEQ ID NO: 976554 - DNA, 25 bp, Mus musculus
tttgtggccatatggtgtcagatga

SEQ ID NO: 976555 - DNA, 25 bp, Mus musculus
tttgtggccatcaaaacagcccagg

SEQ ID NO: 976556 - DNA, 25 bp, Mus musculus
tttgtggccatctaaacagcccagg

SEQ ID NO: 976557 - DNA, 25 bp, Mus musculus
tttgtggccattaccatttcccaaa

SEQ ID NO: 976558 - DNA, 25 bp, Mus musculus
tttgtggccatttccatttcccaaa

SEQ ID NO: 976559 - DNA, 25 bp, Mus musculus
tttgtggccctcaggaacctactta

SEQ ID NO: 976560 - DNA, 25 bp, Mus musculus
tttgtggccctctggaacctactta

SEQ ID NO: 976561 - DNA, 25 bp, Mus musculus
tttgtggccgtcacaggaacccaag

SEQ ID NO: 976562 - DNA, 25 bp, Mus musculus
tttgtggccgtctcaggaacccaag

SEQ ID NO: 976563 - DNA, 25 bp, Mus musculus
tttgtggcctcaactgcaagagtgg

SEQ ID NO: 976564 - DNA, 25 bp, Mus musculus
tttgtggcctcatctgcaagagtgg

SEQ ID NO: 976565 - DNA, 25 bp, Mus musculus
tttgtggcctctccaggatgaacat

SEQ ID NO: 976566 - DNA, 25 bp, Mus musculus
tttgtggcctctgcaggatgaacat

SEQ ID NO: 976567 - DNA, 25 bp, Mus musculus
tttgtggcgaatctaattaaatgac

SEQ ID NO: 976568 - DNA, 25 bp, Mus musculus
tttgtggcgaatgtaattaaatgac

SEQ ID NO: 976569 - DNA, 25 bp, Mus musculus
tttgtggcggcacctaccaaggagc

SEQ ID NO: 976570 - DNA, 25 bp, Mus musculus
tttgtggcggcagctaccaaggagc

SEQ ID NO: 976571 - DNA, 25 bp, Mus musculus
tttgtggctagcaaggagtcccagt

SEQ ID NO: 976572 - DNA, 25 bp, Mus musculus
tttgtggctagctaggagtcccagt

SEQ ID NO: 976573 - DNA, 25 bp, Mus musculus
tttgtggctgagcttggtcttgaac

SEQ ID NO: 976574 - DNA, 25 bp, Mus musculus
tttgtggctgaggttggtcttgaac

SEQ ID NO: 976575 - DNA, 25 bp, Mus musculus
tttgtggctgtaatgcagggctccc

SEQ ID NO: 976576 - DNA, 25 bp, Mus musculus
tttgtggctgtattgcagggctccc

SEQ ID NO: 976577 - DNA, 25 bp, Mus musculus
tttgtggcttagaacctgcttggga

SEQ ID NO: 976578 - DNA, 25 bp, Mus musculus
tttgtggcttagtacctgcttggga

SEQ ID NO: 976579 - DNA, 25 bp, Mus musculus
tttgtggcttctccagtttcatctt

SEQ ID NO: 976580 - DNA, 25 bp, Mus musculus
tttgtggcttctgcagtttcatctt

SEQ ID NO: 976581 - DNA, 25 bp, Mus musculus
tttgtggcttgcaatattgctgaaa

SEQ ID NO: 976582 - DNA, 25 bp, Mus musculus
tttgtggcttgctatattgctgaaa

SEQ ID NO: 976583 - DNA, 25 bp, Mus musculus
tttgtggcttttcagtatgtgctcc

SEQ ID NO: 976584 - DNA, 25 bp, Mus musculus
tttgtggcttttgagtatgtgctcc

SEQ ID NO: 976585 - DNA, 25 bp, Mus musculus
tttgtgggagtcatcttacttcttc

SEQ ID NO: 976586 - DNA, 25 bp, Mus musculus
tttgtgggagtcttcttacttcttc

SEQ ID NO: 976587 - DNA, 25 bp, Mus musculus
tttgtgggccttctgtaaacctggc

SEQ ID NO: 976588 - DNA, 25 bp, Mus musculus
tttgtgggccttgtgtaaacctggc

SEQ ID NO: 976589 - DNA, 25 bp, Mus musculus
tttgtgggcggaccttcctgccaga

SEQ ID NO: 976590 - DNA, 25 bp, Mus musculus
tttgtgggcggagcttcctgccaga

SEQ ID NO: 976591 - DNA, 25 bp, Mus musculus
tttgtgggctggcagggacagatcc

SEQ ID NO: 976592 - DNA, 25 bp, Mus musculus
tttgtgggctgggagggacagatcc

SEQ ID NO: 976593 - DNA, 25 bp, Mus musculus
tttgtgggtgtgaattgaaagtcta

SEQ ID NO: 976594 - DNA, 25 bp, Mus musculus
tttgtgggtgtgtattgaaagtcta

SEQ ID NO: 976595 - DNA, 25 bp, Mus musculus
tttgtggtcaccagacctgagttcc

SEQ ID NO: 976596 - DNA, 25 bp, Mus musculus
tttgtggtcacctgacctgagttcc

SEQ ID NO: 976597 - DNA, 25 bp, Mus musculus
tttgtggtccacctcattctaaacc

SEQ ID NO: 976598 - DNA, 25 bp, Mus musculus
tttgtggtccacgtcattctaaacc

SEQ ID NO: 976599 - DNA, 25 bp, Mus musculus
tttgtggtcccgattctcatcatgg

SEQ ID NO: 976600 - DNA, 25 bp, Mus musculus
tttgtggtcccgtttctcatcatgg

SEQ ID NO: 976601 - DNA, 25 bp, Mus musculus
tttgtggtctccactctagcaatat

SEQ ID NO: 976602 - DNA, 25 bp, Mus musculus
tttgtggtctcctctctagcaatat

SEQ ID NO: 976603 - DNA, 25 bp, Mus musculus
tttgtggtgacaacccaagtgtcct

SEQ ID NO: 976604 - DNA, 25 bp, Mus musculus
tttgtggtgacatcccaagtgtcct

SEQ ID NO: 976605 - DNA, 25 bp, Mus musculus
tttgtggtgagaaccctgggttttg

SEQ ID NO: 976606 - DNA, 25 bp, Mus musculus
tttgtggtgagatccctgggttttg

SEQ ID NO: 976607 - DNA, 25 bp, Mus musculus
tttgtggtggcccatgttaagaaga

SEQ ID NO: 976608 - DNA, 25 bp, Mus musculus
tttgtggtggccgatgttaagaaga

SEQ ID NO: 976609 - DNA, 25 bp, Mus musculus
tttgtggtggctaagaaaaacattc

SEQ ID NO: 976610 - DNA, 25 bp, Mus musculus
tttgtggtggcttagaaaaacattc

SEQ ID NO: 976611 - DNA, 25 bp, Mus musculus
tttgtggtgggcacagtgatagcat

SEQ ID NO: 976612 - DNA, 25 bp, Mus musculus
tttgtggtgggctcagtgatagcat

SEQ ID NO: 976613 - DNA, 25 bp, Mus musculus
tttgtggttcatatggtggcatcct

SEQ ID NO: 976614 - DNA, 25 bp, Mus musculus
tttgtggttcatttggtggcatcct

SEQ ID NO: 976615 - DNA, 25 bp, Mus musculus
tttgtggttccacaacgttccccag

SEQ ID NO: 976616 - DNA, 25 bp, Mus musculus
tttgtggttccagaacgttccccag

SEQ ID NO: 976617 - DNA, 25 bp, Mus musculus
tttgtggttcctaactcccattggt

SEQ ID NO: 976618 - DNA, 25 bp, Mus musculus
tttgtggttccttactcccattggt

SEQ ID NO: 976619 - DNA, 25 bp, Mus musculus
tttgtgtaatacatagatctgacta

SEQ ID NO: 976620 - DNA, 25 bp, Mus musculus
tttgtgtaatacttagatctgacta

SEQ ID NO: 976621 - DNA, 25 bp, Mus musculus
tttgtgtacagtatgcccttagtct

SEQ ID NO: 976622 - DNA, 25 bp, Mus musculus
tttgtgtacagtttgcccttagtct

SEQ ID NO: 976623 - DNA, 25 bp, Mus musculus
tttgtgtaccgcagggaacgtcgcc

SEQ ID NO: 976624 - DNA, 25 bp, Mus musculus
tttgtgtaccgctgggaacgtcgcc

SEQ ID NO: 976625 - DNA, 25 bp, Mus musculus
tttgtgtagtgtaaggccacccgcg

SEQ ID NO: 976626 - DNA, 25 bp, Mus musculus
tttgtgtagtgttaggccacccgcg

SEQ ID NO: 976627 - DNA, 25 bp, Mus musculus
tttgtgtatttccatgcgcaccatg

SEQ ID NO: 976628 - DNA, 25 bp, Mus musculus
tttgtgtatttcgatgcgcaccatg

SEQ ID NO: 976629 - DNA, 25 bp, Mus musculus
tttgtgtcacaaccctcttccatgt

SEQ ID NO: 976630 - DNA, 25 bp, Mus musculus
tttgtgtcacaagcctcttccatgt

SEQ ID NO: 976631 - DNA, 25 bp, Mus musculus
tttgtgtcacttcgggtatcagtag

SEQ ID NO: 976632 - DNA, 25 bp, Mus musculus
tttgtgtcacttggggtatcagtag

SEQ ID NO: 976633 - DNA, 25 bp, Mus musculus
tttgtgtcaggaaaaatagctttct

SEQ ID NO: 976634 - DNA, 25 bp, Mus musculus
tttgtgtcaggataaatagctttct

SEQ ID NO: 976635 - DNA, 25 bp, Mus musculus
tttgtgtcatacatttccagtaatg

SEQ ID NO: 976636 - DNA, 25 bp, Mus musculus
tttgtgtcatacttttccagtaatg

SEQ ID NO: 976637 - DNA, 25 bp, Mus musculus
tttgtgtcgcacactactctggaga

SEQ ID NO: 976638 - DNA, 25 bp, Mus musculus
tttgtgtcgcactctactctggaga

SEQ ID NO: 976639 - DNA, 25 bp, Mus musculus
tttgtgtcggcaccgggccaactgt

SEQ ID NO: 976640 - DNA, 25 bp, Mus musculus
tttgtgtcggcagcgggccaactgt

SEQ ID NO: 976641 - DNA, 25 bp, Mus musculus
tttgtgtcgggcacagcagatgaaa

SEQ ID NO: 976642 - DNA, 25 bp, Mus musculus
tttgtgtcgggctcagcagatgaaa

SEQ ID NO: 976643 - DNA, 25 bp, Mus musculus
tttgtgtcgtgtcattgcgtgtgct

SEQ ID NO: 976644 - DNA, 25 bp, Mus musculus
tttgtgtcgtgtgattgcgtgtgct

SEQ ID NO: 976645 - DNA, 25 bp, Mus musculus
tttgtgtctcccaaagttctgtttt

SEQ ID NO: 976646 - DNA, 25 bp, Mus musculus
tttgtgtctccctaagttctgtttt

SEQ ID NO: 976647 - DNA, 25 bp, Mus musculus
tttgtgtctcttaggcactaggcat

SEQ ID NO: 976648 - DNA, 25 bp, Mus musculus
tttgtgtctctttggcactaggcat

SEQ ID NO: 976649 - DNA, 25 bp, Mus musculus
tttgtgtgacagagagcccctgtcc

SEQ ID NO: 976650 - DNA, 25 bp, Mus musculus
tttgtgtgacagtgagcccctgtcc

SEQ ID NO: 976651 - DNA, 25 bp, Mus musculus
tttgtgtgaggtcccacaggtgtct

SEQ ID NO: 976652 - DNA, 25 bp, Mus musculus
tttgtgtgaggtgccacaggtgtct

SEQ ID NO: 976653 - DNA, 25 bp, Mus musculus
tttgtgtgatcactcagacgctcct

SEQ ID NO: 976654 - DNA, 25 bp, Mus musculus
tttgtgtgatcagtcagacgctcct

SEQ ID NO: 976655 - DNA, 25 bp, Mus musculus
tttgtgtgcattctcctttcccagc

SEQ ID NO: 976656 - DNA, 25 bp, Mus musculus
tttgtgtgcattgtcctttcccagc

SEQ ID NO: 976657 - DNA, 25 bp, Mus musculus
tttgtgtgcccacactcaaggttaa

SEQ ID NO: 976658 - DNA, 25 bp, Mus musculus
tttgtgtgcccagactcaaggttaa

SEQ ID NO: 976659 - DNA, 25 bp, Mus musculus
tttgtgtgccctagtcctgtggttt

SEQ ID NO: 976660 - DNA, 25 bp, Mus musculus
tttgtgtgcccttgtcctgtggttt

SEQ ID NO: 976661 - DNA, 25 bp, Mus musculus
tttgtgtgcctacctctggacaggg

SEQ ID NO: 976662 - DNA, 25 bp, Mus musculus
tttgtgtgcctagctctggacaggg

SEQ ID NO: 976663 - DNA, 25 bp, Mus musculus
tttgtgtgcgagctagttttgcttt

SEQ ID NO: 976664 - DNA, 25 bp, Mus musculus
tttgtgtgcgaggtagttttgcttt

SEQ ID NO: 976665 - DNA, 25 bp, Mus musculus
tttgtgtgctgtccatgcagaccgg

SEQ ID NO: 976666 - DNA, 25 bp, Mus musculus
tttgtgtgctgtgcatgcagaccgg

SEQ ID NO: 976667 - DNA, 25 bp, Mus musculus
tttgtgtgcttcaacacctacaact

SEQ ID NO: 976668 - DNA, 25 bp, Mus musculus
tttgtgtgcttctacacctacaact

SEQ ID NO: 976669 - DNA, 25 bp, Mus musculus
tttgtgtggcaacctagtcctcggt

SEQ ID NO: 976670 - DNA, 25 bp, Mus musculus
tttgtgtggcaagctagtcctcggt

SEQ ID NO: 976671 - DNA, 25 bp, Mus musculus
tttgtgtggccaatcatcgatccca

SEQ ID NO: 976672 - DNA, 25 bp, Mus musculus
tttgtgtggccattcatcgatccca

SEQ ID NO: 976673 - DNA, 25 bp, Mus musculus
tttgtgtggtttcttagcatatcaa

SEQ ID NO: 976674 - DNA, 25 bp, Mus musculus
tttgtgtggtttgttagcatatcaa

SEQ ID NO: 976675 - DNA, 25 bp, Mus musculus
tttgtgtgtagtatgtttgattgtt

SEQ ID NO: 976676 - DNA, 25 bp, Mus musculus
tttgtgtgtagtttgtttgattgtt

SEQ ID NO: 976677 - DNA, 25 bp, Mus musculus
tttgtgtgtcagctgggccttgaat

SEQ ID NO: 976678 - DNA, 25 bp, Mus musculus
tttgtgtgtcaggtgggccttgaat

SEQ ID NO: 976679 - DNA, 25 bp, Mus musculus
tttgtgtgtctacccactatgtttt

SEQ ID NO: 976680 - DNA, 25 bp, Mus musculus
tttgtgtgtctagccactatgtttt

SEQ ID NO: 976681 - DNA, 25 bp, Mus musculus
tttgtgtgtgaaccgcagccttact

SEQ ID NO: 976682 - DNA, 25 bp, Mus musculus
tttgtgtgtgaagcgcagccttact

SEQ ID NO: 976683 - DNA, 25 bp, Mus musculus
tttgtgtgtgacatccggccggaaa

SEQ ID NO: 976684 - DNA, 25 bp, Mus musculus
tttgtgtgtgacttccggccggaaa

SEQ ID NO: 976685 - DNA, 25 bp, Mus musculus
tttgtgtgtgctaagtagacactct

SEQ ID NO: 976686 - DNA, 25 bp, Mus musculus
tttgtgtgtgcttagtagacactct

SEQ ID NO: 976687 - DNA, 25 bp, Mus musculus
tttgtgtgtgtacagctgctttgtc

SEQ ID NO: 976688 - DNA, 25 bp, Mus musculus
tttgtgtgtgtagagctgctttgtc

SEQ ID NO: 976689 - DNA, 25 bp, Mus musculus
tttgtgtgttgcctgcagcctgttc

SEQ ID NO: 976690 - DNA, 25 bp, Mus musculus
tttgtgtgttgcgtgcagcctgttc

SEQ ID NO: 976691 - DNA, 25 bp, Mus musculus
tttgtgtgtttgagtccatcgctga

SEQ ID NO: 976692 - DNA, 25 bp, Mus musculus
tttgtgtgtttgtgtccatcgctga

SEQ ID NO: 976693 - DNA, 25 bp, Mus musculus
tttgtgtgttttctccttgtttaag

SEQ ID NO: 976694 - DNA, 25 bp, Mus musculus
tttgtgtgttttgtccttgtttaag

SEQ ID NO: 976695 - DNA, 25 bp, Mus musculus
tttgtgttacagcagtttctggaga

SEQ ID NO: 976696 - DNA, 25 bp, Mus musculus
tttgtgttacaggagtttctggaga

SEQ ID NO: 976697 - DNA, 25 bp, Mus musculus
tttgtgttcacacctcctgcaggcg

SEQ ID NO: 976698 - DNA, 25 bp, Mus musculus
tttgtgttcacagctcctgcaggcg

SEQ ID NO: 976699 - DNA, 25 bp, Mus musculus
tttgtgttctatccacctgaccgaa

SEQ ID NO: 976700 - DNA, 25 bp, Mus musculus
tttgtgttctatgcacctgaccgaa

SEQ ID NO: 976701 - DNA, 25 bp, Mus musculus
tttgtgttgggcaatcggcaggaca

SEQ ID NO: 976702 - DNA, 25 bp, Mus musculus
tttgtgttgggctatcggcaggaca

SEQ ID NO: 976703 - DNA, 25 bp, Mus musculus
tttgtgttgtaccagcgcatgcctt

SEQ ID NO: 976704 - DNA, 25 bp, Mus musculus
tttgtgttgtacgagcgcatgcctt

SEQ ID NO: 976705 - DNA, 25 bp, Mus musculus
tttgtgtttactatctggctggagc

SEQ ID NO: 976706 - DNA, 25 bp, Mus musculus
tttgtgtttactttctggctggagc

SEQ ID NO: 976707 - DNA, 25 bp, Mus musculus
tttgtgtttataactattactgttt

SEQ ID NO: 976708 - DNA, 25 bp, Mus musculus
tttgtgtttatatctattactgttt

SEQ ID NO: 976709 - DNA, 25 bp, Mus musculus
tttgtgtttcacacacacctgtcaa

SEQ ID NO: 976710 - DNA, 25 bp, Mus musculus
tttgtgtttcactcacacctgtcaa

SEQ ID NO: 976711 - DNA, 25 bp, Mus musculus
tttgtgtttcttaagggcatccgta

SEQ ID NO: 976712 - DNA, 25 bp, Mus musculus
tttgtgtttcttacctttgtgcgtt

SEQ ID NO: 976713 - DNA, 25 bp, Mus musculus
tttgtgtttctttagggcatccgta

SEQ ID NO: 976714 - DNA, 25 bp, Mus musculus
tttgtgtttctttcctttgtgcgtt

SEQ ID NO: 976715 - DNA, 25 bp, Mus musculus
tttgtgtttggcagcacctgcataa

SEQ ID NO: 976716 - DNA, 25 bp, Mus musculus
tttgtgtttggctgcacctgcataa

SEQ ID NO: 976717 - DNA, 25 bp, Mus musculus
tttgtgtttgtaaagccccttccag

SEQ ID NO: 976718 - DNA, 25 bp, Mus musculus
tttgtgtttgtatagccccttccag

SEQ ID NO: 976719 - DNA, 25 bp, Mus musculus
tttgtgttttaactgccacacctgc

SEQ ID NO: 976720 - DNA, 25 bp, Mus musculus
tttgtgttttaagtgccacacctgc

SEQ ID NO: 976721 - DNA, 25 bp, Mus musculus
tttgtgttttgcataatttccatgt

SEQ ID NO: 976722 - DNA, 25 bp, Mus musculus
tttgtgttttgccaagcatgtccct

SEQ ID NO: 976723 - DNA, 25 bp, Mus musculus
tttgtgttttgcgaagcatgtccct

SEQ ID NO: 976724 - DNA, 25 bp, Mus musculus
tttgtgttttgcttaatttccatgt

SEQ ID NO: 976725 - DNA, 25 bp, Mus musculus
tttgtgtttttcactgtgctctctg

SEQ ID NO: 976726 - DNA, 25 bp, Mus musculus
tttgtgtttttctctgtgctctctg

SEQ ID NO: 976727 - DNA, 25 bp, Mus musculus
tttgttaaagcacccactggtctct

SEQ ID NO: 976728 - DNA, 25 bp, Mus musculus
tttgttaaagcagccactggtctct

SEQ ID NO: 976729 - DNA, 25 bp, Mus musculus
tttgttaacactatgctgctccctc

SEQ ID NO: 976730 - DNA, 25 bp, Mus musculus
tttgttaacactttgctgctccctc

SEQ ID NO: 976731 - DNA, 25 bp, Mus musculus
tttgttaagtaccacgcttccgcca

SEQ ID NO: 976732 - DNA, 25 bp, Mus musculus
tttgttaagtacgacgcttccgcca

SEQ ID NO: 976733 - DNA, 25 bp, Mus musculus
tttgttaatggcaagcacagcacca

SEQ ID NO: 976734 - DNA, 25 bp, Mus musculus
tttgttaatggctagcacagcacca

SEQ ID NO: 976735 - DNA, 25 bp, Mus musculus
tttgttacacccagcccctggatga

SEQ ID NO: 976736 - DNA, 25 bp, Mus musculus
tttgttacaccctgcccctggatga

SEQ ID NO: 976737 - DNA, 25 bp, Mus musculus
tttgttacagagacctgcaaaggaa

SEQ ID NO: 976738 - DNA, 25 bp, Mus musculus
tttgttacagagtcctgcaaaggaa

SEQ ID NO: 976739 - DNA, 25 bp, Mus musculus
tttgttacatcaaccctaagaacag

SEQ ID NO: 976740 - DNA, 25 bp, Mus musculus
tttgttacatcatccctaagaacag

SEQ ID NO: 976741 - DNA, 25 bp, Mus musculus
tttgttacatgaagtccgctgggaa

SEQ ID NO: 976742 - DNA, 25 bp, Mus musculus
tttgttacatgatgtccgctgggaa

SEQ ID NO: 976743 - DNA, 25 bp, Mus musculus
tttgttaccaagcagcatttgataa

SEQ ID NO: 976744 - DNA, 25 bp, Mus musculus
tttgttaccaaggagcatttgataa

SEQ ID NO: 976745 - DNA, 25 bp, Mus musculus
tttgttaccatcatctcagttctca

SEQ ID NO: 976746 - DNA, 25 bp, Mus musculus
tttgttaccatcttctcagttctca

SEQ ID NO: 976747 - DNA, 25 bp, Mus musculus
tttgttaccgttatatggtgccaag

SEQ ID NO: 976748 - DNA, 25 bp, Mus musculus
tttgttaccgttttatggtgccaag

SEQ ID NO: 976749 - DNA, 25 bp, Mus musculus
tttgttacctatagtctctctagcc

SEQ ID NO: 976750 - DNA, 25 bp, Mus musculus
tttgttacctattgtctctctagcc

SEQ ID NO: 976751 - DNA, 25 bp, Mus musculus
tttgttacggcaaccatgagccaaa

SEQ ID NO: 976752 - DNA, 25 bp, Mus musculus
tttgttacggcatccatgagccaaa

SEQ ID NO: 976753 - DNA, 25 bp, Mus musculus
tttgttacggtaatctgagctgagt

SEQ ID NO: 976754 - DNA, 25 bp, Mus musculus
tttgttacggtattctgagctgagt

SEQ ID NO: 976755 - DNA, 25 bp, Mus musculus
tttgttacgtctaagggaactgaag

SEQ ID NO: 976756 - DNA, 25 bp, Mus musculus
tttgttacgtcttagggaactgaag

SEQ ID NO: 976757 - DNA, 25 bp, Mus musculus
tttgttacttaaactcacgtcctca

SEQ ID NO: 976758 - DNA, 25 bp, Mus musculus
tttgttacttaatctcacgtcctca

SEQ ID NO: 976759 - DNA, 25 bp, Mus musculus
tttgttacttttctactgtcactgg

SEQ ID NO: 976760 - DNA, 25 bp, Mus musculus
tttgttacttttgtactgtcactgg

SEQ ID NO: 976761 - DNA, 25 bp, Mus musculus
tttgttagagaacccacgagagact

SEQ ID NO: 976762 - DNA, 25 bp, Mus musculus
tttgttagagaagccacgagagact

SEQ ID NO: 976763 - DNA, 25 bp, Mus musculus
tttgttagcttcctgggttcccatg

SEQ ID NO: 976764 - DNA, 25 bp, Mus musculus
tttgttagcttcgtgggttcccatg

SEQ ID NO: 976765 - DNA, 25 bp, Mus musculus
tttgttatagctagccccgaggagc

SEQ ID NO: 976766 - DNA, 25 bp, Mus musculus
tttgttatagcttgccccgaggagc

SEQ ID NO: 976767 - DNA, 25 bp, Mus musculus
tttgttatcagtctttactgtccat

SEQ ID NO: 976768 - DNA, 25 bp, Mus musculus
tttgttatcagtgtttactgtccat

SEQ ID NO: 976769 - DNA, 25 bp, Mus musculus
tttgttatccgtagtctctgaagtg

SEQ ID NO: 976770 - DNA, 25 bp, Mus musculus
tttgttatccgttgtctctgaagtg

SEQ ID NO: 976771 - DNA, 25 bp, Mus musculus
tttgttatgcaaagaaaggttactc

SEQ ID NO: 976772 - DNA, 25 bp, Mus musculus
tttgttatgcaatgaaaggttactc

SEQ ID NO: 976773 - DNA, 25 bp, Mus musculus
tttgttatgttcactcacttctcag

SEQ ID NO: 976774 - DNA, 25 bp, Mus musculus
tttgttatgttctctcacttctcag

SEQ ID NO: 976775 - DNA, 25 bp, Mus musculus
tttgttattacgcttctcttcttcc

SEQ ID NO: 976776 - DNA, 25 bp, Mus musculus
tttgttattacggttctcttcttcc

SEQ ID NO: 976777 - DNA, 25 bp, Mus musculus
tttgttattttcagccctgagcctg

SEQ ID NO: 976778 - DNA, 25 bp, Mus musculus
tttgttattttctgccctgagcctg

SEQ ID NO: 976779 - DNA, 25 bp, Mus musculus
tttgttcaaagtctagcttcctcct

SEQ ID NO: 976780 - DNA, 25 bp, Mus musculus
tttgttcaaagtgtagcttcctcct

SEQ ID NO: 976781 - DNA, 25 bp, Mus musculus
tttgttcaactacctcttaaagtgg

SEQ ID NO: 976782 - DNA, 25 bp, Mus musculus
tttgttcaactagctcttaaagtgg

SEQ ID NO: 976783 - DNA, 25 bp, Mus musculus
tttgttcaattgacctgaggcactg

SEQ ID NO: 976784 - DNA, 25 bp, Mus musculus
tttgttcaattgtcctgaggcactg

SEQ ID NO: 976785 - DNA, 25 bp, Mus musculus
tttgttcaggaaaactaatcatagt

SEQ ID NO: 976786 - DNA, 25 bp, Mus musculus
tttgttcaggaatactaatcatagt

SEQ ID NO: 976787 - DNA, 25 bp, Mus musculus
tttgttcagtccaccgacctgagag

SEQ ID NO: 976788 - DNA, 25 bp, Mus musculus
tttgttcagtcctccgacctgagag

SEQ ID NO: 976789 - DNA, 25 bp, Mus musculus
tttgttcattaccaggaatcctcct

SEQ ID NO: 976790 - DNA, 25 bp, Mus musculus
tttgttcattacgaggaatcctcct

SEQ ID NO: 976791 - DNA, 25 bp, Mus musculus
tttgttcattcgatcactttaacaa

SEQ ID NO: 976792 - DNA, 25 bp, Mus musculus
tttgttcattcgttcactttaacaa

SEQ ID NO: 976793 - DNA, 25 bp, Mus musculus
tttgttccaaaacgtgctgccttcc

SEQ ID NO: 976794 - DNA, 25 bp, Mus musculus
tttgttccaaaaggtgctgccttcc

SEQ ID NO: 976795 - DNA, 25 bp, Mus musculus
tttgttccacttcaacgtccaggag

SEQ ID NO: 976796 - DNA, 25 bp, Mus musculus
tttgttccacttgaacgtccaggag

SEQ ID NO: 976797 - DNA, 25 bp, Mus musculus
tttgttccagctacgtgcaatacca

SEQ ID NO: 976798 - DNA, 25 bp, Mus musculus
tttgttccagcttcgtgcaatacca

SEQ ID NO: 976799 - DNA, 25 bp, Mus musculus
tttgttccattcataagcatatact

SEQ ID NO: 976800 - DNA, 25 bp, Mus musculus
tttgttccattcttaagcatatact

SEQ ID NO: 976801 - DNA, 25 bp, Mus musculus
tttgttcccacaccctgaggaggag

SEQ ID NO: 976802 - DNA, 25 bp, Mus musculus
tttgttcccacagcctgaggaggag

SEQ ID NO: 976803 - DNA, 25 bp, Mus musculus
tttgttcccacccagctaactgctg

SEQ ID NO: 976804 - DNA, 25 bp, Mus musculus
tttgttcccaccgagctaactgctg

SEQ ID NO: 976805 - DNA, 25 bp, Mus musculus
tttgttcccagacggtccagttttg

SEQ ID NO: 976806 - DNA, 25 bp, Mus musculus
tttgttcccagagggtccagttttg

SEQ ID NO: 976807 - DNA, 25 bp, Mus musculus
tttgttcccagcacagcaaacgtgt

SEQ ID NO: 976808 - DNA, 25 bp, Mus musculus
tttgttcccagctcagcaaacgtgt

SEQ ID NO: 976809 - DNA, 25 bp, Mus musculus
tttgttcccattcacacagcacagg

SEQ ID NO: 976810 - DNA, 25 bp, Mus musculus
tttgttcccattgacacagcacagg

SEQ ID NO: 976811 - DNA, 25 bp, Mus musculus
tttgttccccttctgtaagctctct

SEQ ID NO: 976812 - DNA, 25 bp, Mus musculus
tttgttccccttgtgtaagctctct

SEQ ID NO: 976813 - DNA, 25 bp, Mus musculus
tttgttccgaagcagcagggagccc

SEQ ID NO: 976814 - DNA, 25 bp, Mus musculus
tttgttccgaaggagcagggagccc

SEQ ID NO: 976815 - DNA, 25 bp, Mus musculus
tttgttcctgctataatcatttgtt

SEQ ID NO: 976816 - DNA, 25 bp, Mus musculus
tttgttcctgctttaatcatttgtt

SEQ ID NO: 976817 - DNA, 25 bp, Mus musculus
tttgttcctggtcccagtcattgga

SEQ ID NO: 976818 - DNA, 25 bp, Mus musculus
tttgttcctggtgccagtcattgga

SEQ ID NO: 976819 - DNA, 25 bp, Mus musculus
tttgttcctgtcattcagtgtagaa

SEQ ID NO: 976820 - DNA, 25 bp, Mus musculus
tttgttcctgtctttcagtgtagaa

SEQ ID NO: 976821 - DNA, 25 bp, Mus musculus
tttgttccttggcaggtttgcattt

SEQ ID NO: 976822 - DNA, 25 bp, Mus musculus
tttgttccttgggaggtttgcattt

SEQ ID NO: 976823 - DNA, 25 bp, Mus musculus
tttgttcgtcgcactcggatgcaca

SEQ ID NO: 976824 - DNA, 25 bp, Mus musculus
tttgttcgtcgctctcggatgcaca

SEQ ID NO: 976825 - DNA, 25 bp, Mus musculus
tttgttctacaactggctgagcctg

SEQ ID NO: 976826 - DNA, 25 bp, Mus musculus
tttgttctacaagtggctgagcctg

SEQ ID NO: 976827 - DNA, 25 bp, Mus musculus
tttgttctacacatgctcaacacat

SEQ ID NO: 976828 - DNA, 25 bp, Mus musculus
tttgttctacacttgctcaacacat

SEQ ID NO: 976829 - DNA, 25 bp, Mus musculus
tttgttctacctatgccacacttta

SEQ ID NO: 976830 - DNA, 25 bp, Mus musculus
tttgttctacctttgccacacttta

SEQ ID NO: 976831 - DNA, 25 bp, Mus musculus
tttgttctactactgctacatactt

SEQ ID NO: 976832 - DNA, 25 bp, Mus musculus
tttgttctactagtgctacatactt

SEQ ID NO: 976833 - DNA, 25 bp, Mus musculus
tttgttctagaacgcgctcctttca

SEQ ID NO: 976834 - DNA, 25 bp, Mus musculus
tttgttctagaaggcgctcctttca

SEQ ID NO: 976835 - DNA, 25 bp, Mus musculus
tttgttctatgtacttgcctttccc

SEQ ID NO: 976836 - DNA, 25 bp, Mus musculus
tttgttctatgtcacttggtttgga

SEQ ID NO: 976837 - DNA, 25 bp, Mus musculus
tttgttctatgtgacttggtttgga

SEQ ID NO: 976838 - DNA, 25 bp, Mus musculus
tttgttctatgttcttgcctttccc

SEQ ID NO: 976839 - DNA, 25 bp, Mus musculus
tttgttctcaacacgtaaggtagtg

SEQ ID NO: 976840 - DNA, 25 bp, Mus musculus
tttgttctcaactcgtaaggtagtg

SEQ ID NO: 976841 - DNA, 25 bp, Mus musculus
tttgttctcataccatctccatagg

SEQ ID NO: 976842 - DNA, 25 bp, Mus musculus
tttgttctcatagcatctccatagg

SEQ ID NO: 976843 - DNA, 25 bp, Mus musculus
tttgttctcttcatcagcaaaatga

SEQ ID NO: 976844 - DNA, 25 bp, Mus musculus
tttgttctcttcatgaaattcagtt

SEQ ID NO: 976845 - DNA, 25 bp, Mus musculus
tttgttctcttcttcagcaaaatga

SEQ ID NO: 976846 - DNA, 25 bp, Mus musculus
tttgttctcttcttgaaattcagtt

SEQ ID NO: 976847 - DNA, 25 bp, Mus musculus
tttgttctcttgagaacaccaggaa

SEQ ID NO: 976848 - DNA, 25 bp, Mus musculus
tttgttctcttgtgaacaccaggaa

SEQ ID NO: 976849 - DNA, 25 bp, Mus musculus
tttgttctctttcacaccccatagc

SEQ ID NO: 976850 - DNA, 25 bp, Mus musculus
tttgttctctttctcgttcctgttg

SEQ ID NO: 976851 - DNA, 25 bp, Mus musculus
tttgttctctttgacaccccatagc

SEQ ID NO: 976852 - DNA, 25 bp, Mus musculus
tttgttctctttgtcgttcctgttg

SEQ ID NO: 976853 - DNA, 25 bp, Mus musculus
tttgttctgatgactcactgtagtg

SEQ ID NO: 976854 - DNA, 25 bp, Mus musculus
tttgttctgatgtctcactgtagtg

SEQ ID NO: 976855 - DNA, 25 bp, Mus musculus
tttgttctgtctcttggactgttag

SEQ ID NO: 976856 - DNA, 25 bp, Mus musculus
tttgttctgtctgttggactgttag

SEQ ID NO: 976857 - DNA, 25 bp, Mus musculus
tttgttctgtgtcgctcagactgaa

SEQ ID NO: 976858 - DNA, 25 bp, Mus musculus
tttgttctgtgtggctcagactgaa

SEQ ID NO: 976859 - DNA, 25 bp, Mus musculus
tttgttcttagactttccatcaggt

SEQ ID NO: 976860 - DNA, 25 bp, Mus musculus
tttgttcttagagtttccatcaggt

SEQ ID NO: 976861 - DNA, 25 bp, Mus musculus
tttgttcttcctcttagcctcattt

SEQ ID NO: 976862 - DNA, 25 bp, Mus musculus
tttgttcttcctgttagcctcattt

SEQ ID NO: 976863 - DNA, 25 bp, Mus musculus
tttgttcttggacggctctggacac

SEQ ID NO: 976864 - DNA, 25 bp, Mus musculus
tttgttcttggagggctctggacac

SEQ ID NO: 976865 - DNA, 25 bp, Mus musculus
tttgttgaaaccagtagtcctactt

SEQ ID NO: 976866 - DNA, 25 bp, Mus musculus
tttgttgaaacctgtagtcctactt

SEQ ID NO: 976867 - DNA, 25 bp, Mus musculus
tttgttgaagaaagcaagtttcccc

SEQ ID NO: 976868 - DNA, 25 bp, Mus musculus
tttgttgaagaatgcaagtttcccc

SEQ ID NO: 976869 - DNA, 25 bp, Mus musculus
tttgttgaaggacatcggccgccga

SEQ ID NO: 976870 - DNA, 25 bp, Mus musculus
tttgttgaaggagatcggccgccga

SEQ ID NO: 976871 - DNA, 25 bp, Mus musculus
tttgttgacacaccacttggacccg

SEQ ID NO: 976872 - DNA, 25 bp, Mus musculus
tttgttgacacagcacttggacccg

SEQ ID NO: 976873 - DNA, 25 bp, Mus musculus
tttgttgaccccagacactcaacca

SEQ ID NO: 976874 - DNA, 25 bp, Mus musculus
tttgttgacccctgacactcaacca

SEQ ID NO: 976875 - DNA, 25 bp, Mus musculus
tttgttgagaacagcttttcagcct

SEQ ID NO: 976876 - DNA, 25 bp, Mus musculus
tttgttgagaactgcttttcagcct

SEQ ID NO: 976877 - DNA, 25 bp, Mus musculus
tttgttgagttaccagactgccgtt

SEQ ID NO: 976878 - DNA, 25 bp, Mus musculus
tttgttgagttagcagactgccgtt

SEQ ID NO: 976879 - DNA, 25 bp, Mus musculus
tttgttgatattatctggcattttg

SEQ ID NO: 976880 - DNA, 25 bp, Mus musculus
tttgttgatattttctggcattttg

SEQ ID NO: 976881 - DNA, 25 bp, Mus musculus
tttgttgcagacatttcttccccaa

SEQ ID NO: 976882 - DNA, 25 bp, Mus musculus
tttgttgcagacttttcttccccaa

SEQ ID NO: 976883 - DNA, 25 bp, Mus musculus
tttgttgcagcaaagaccaggagct

SEQ ID NO: 976884 - DNA, 25 bp, Mus musculus
tttgttgcagcatagaccaggagct

SEQ ID NO: 976885 - DNA, 25 bp, Mus musculus
tttgttgccaaacactatcctatgg

SEQ ID NO: 976886 - DNA, 25 bp, Mus musculus
tttgttgccaaagactatcctatgg

SEQ ID NO: 976887 - DNA, 25 bp, Mus musculus
tttgttgccattccacatttctttc

SEQ ID NO: 976888 - DNA, 25 bp, Mus musculus
tttgttgccattgcacatttctttc

SEQ ID NO: 976889 - DNA, 25 bp, Mus musculus
tttgttgcccaacggcccaatttga

SEQ ID NO: 976890 - DNA, 25 bp, Mus musculus
tttgttgcccaagggcccaatttga

SEQ ID NO: 976891 - DNA, 25 bp, Mus musculus
tttgttgctcttatgaaggacctga

SEQ ID NO: 976892 - DNA, 25 bp, Mus musculus
tttgttgctcttttgaaggacctga

SEQ ID NO: 976893 - DNA, 25 bp, Mus musculus
tttgttgctgacctgcctatctgga

SEQ ID NO: 976894 - DNA, 25 bp, Mus musculus
tttgttgctgacgtgcctatctgga

SEQ ID NO: 976895 - DNA, 25 bp, Mus musculus
tttgttgctgcaaaggtaccattga

SEQ ID NO: 976896 - DNA, 25 bp, Mus musculus
tttgttgctgcactcattgtagtta

SEQ ID NO: 976897 - DNA, 25 bp, Mus musculus
tttgttgctgcagtcattgtagtta

SEQ ID NO: 976898 - DNA, 25 bp, Mus musculus
tttgttgctgcataggtaccattga

SEQ ID NO: 976899 - DNA, 25 bp, Mus musculus
tttgttgctggtaaaactcctacat

SEQ ID NO: 976900 - DNA, 25 bp, Mus musculus
tttgttgctggttaaactcctacat

SEQ ID NO: 976901 - DNA, 25 bp, Mus musculus
tttgttgctgtgagctggaaccata

SEQ ID NO: 976902 - DNA, 25 bp, Mus musculus
tttgttgctgtgtgctggaaccata

SEQ ID NO: 976903 - DNA, 25 bp, Mus musculus
tttgttgctgttcgtatgtccccac

SEQ ID NO: 976904 - DNA, 25 bp, Mus musculus
tttgttgctgttggtatgtccccac

SEQ ID NO: 976905 - DNA, 25 bp, Mus musculus
tttgttgcttggctctgaggttcag

SEQ ID NO: 976906 - DNA, 25 bp, Mus musculus
tttgttgcttgggtctgaggttcag

SEQ ID NO: 976907 - DNA, 25 bp, Mus musculus
tttgttggacctctgggatgctgct

SEQ ID NO: 976908 - DNA, 25 bp, Mus musculus
tttgttggacctgtgggatgctgct

SEQ ID NO: 976909 - DNA, 25 bp, Mus musculus
tttgttggcagacttggccttcatg

SEQ ID NO: 976910 - DNA, 25 bp, Mus musculus
tttgttggcagagttggccttcatg

SEQ ID NO: 976911 - DNA, 25 bp, Mus musculus
tttgttggccctatgaaattctgca

SEQ ID NO: 976912 - DNA, 25 bp, Mus musculus
tttgttggccctttgaaattctgca

SEQ ID NO: 976913 - DNA, 25 bp, Mus musculus
tttgttggccgcctgctaatagcca

SEQ ID NO: 976914 - DNA, 25 bp, Mus musculus
tttgttggccgcgtgctaatagcca

SEQ ID NO: 976915 - DNA, 25 bp, Mus musculus
tttgttggcctccatcttgcttcct

SEQ ID NO: 976916 - DNA, 25 bp, Mus musculus
tttgttggcctcgatcttgcttcct

SEQ ID NO: 976917 - DNA, 25 bp, Mus musculus
tttgttggcgatacttttcccatag

SEQ ID NO: 976918 - DNA, 25 bp, Mus musculus
tttgttggcgattcttttcccatag

SEQ ID NO: 976919 - DNA, 25 bp, Mus musculus
tttgttggtgtgcttttctggttta

SEQ ID NO: 976920 - DNA, 25 bp, Mus musculus
tttgttggtgtggttttctggttta

SEQ ID NO: 976921 - DNA, 25 bp, Mus musculus
tttgttgtacacacatgttcgcaga

SEQ ID NO: 976922 - DNA, 25 bp, Mus musculus
tttgttgtacactcatgttcgcaga

SEQ ID NO: 976923 - DNA, 25 bp, Mus musculus
tttgttgtccttatttccatcctca

SEQ ID NO: 976924 - DNA, 25 bp, Mus musculus
tttgttgtccttttttccatcctca

SEQ ID NO: 976925 - DNA, 25 bp, Mus musculus
tttgttgtgctgcaacttcgcctaa

SEQ ID NO: 976926 - DNA, 25 bp, Mus musculus
tttgttgtgctggaacttcgcctaa

SEQ ID NO: 976927 - DNA, 25 bp, Mus musculus
tttgttgtgtccatgtctaatgaat

SEQ ID NO: 976928 - DNA, 25 bp, Mus musculus
tttgttgtgtccttgtctaatgaat

SEQ ID NO: 976929 - DNA, 25 bp, Mus musculus
tttgttgtgtgaattgaaagtctaa

SEQ ID NO: 976930 - DNA, 25 bp, Mus musculus
tttgttgtgtgatttgaaagtctaa

SEQ ID NO: 976931 - DNA, 25 bp, Mus musculus
tttgttgttgaccatggcacaccat

SEQ ID NO: 976932 - DNA, 25 bp, Mus musculus
tttgttgttgacgatggcacaccat

SEQ ID NO: 976933 - DNA, 25 bp, Mus musculus
tttgttgttggaccgtgtcctcatg

SEQ ID NO: 976934 - DNA, 25 bp, Mus musculus
tttgttgttggagcgtgtcctcatg

SEQ ID NO: 976935 - DNA, 25 bp, Mus musculus
tttgttgttggtcttcgtgctgggt

SEQ ID NO: 976936 - DNA, 25 bp, Mus musculus
tttgttgttggtgttcgtgctgggt

SEQ ID NO: 976937 - DNA, 25 bp, Mus musculus
tttgttgttgtacaaggactcagct

SEQ ID NO: 976938 - DNA, 25 bp, Mus musculus
tttgttgttgtagaaggactcagct

SEQ ID NO: 976939 - DNA, 25 bp, Mus musculus
tttgtttaacatcttccatcactgg

SEQ ID NO: 976940 - DNA, 25 bp, Mus musculus
tttgtttaacatgttccatcactgg

SEQ ID NO: 976941 - DNA, 25 bp, Mus musculus
tttgtttacaaactgctgtggctgt

SEQ ID NO: 976942 - DNA, 25 bp, Mus musculus
tttgtttacaaagtgctgtggctgt

SEQ ID NO: 976943 - DNA, 25 bp, Mus musculus
tttgtttacaatcaggagctttctg

SEQ ID NO: 976944 - DNA, 25 bp, Mus musculus
tttgtttacaatgaggagctttctg

SEQ ID NO: 976945 - DNA, 25 bp, Mus musculus
tttgtttacagtcctcaggcgaaag

SEQ ID NO: 976946 - DNA, 25 bp, Mus musculus
tttgtttacagtgctcaggcgaaag

SEQ ID NO: 976947 - DNA, 25 bp, Mus musculus
tttgtttatcctccttctcaacccc

SEQ ID NO: 976948 - DNA, 25 bp, Mus musculus
tttgtttatcctgcttctcaacccc

SEQ ID NO: 976949 - DNA, 25 bp, Mus musculus
tttgtttatcttacccactttgcat

SEQ ID NO: 976950 - DNA, 25 bp, Mus musculus
tttgtttatctttcccactttgcat

SEQ ID NO: 976951 - DNA, 25 bp, Mus musculus
tttgtttatggtctgcagatggcct

SEQ ID NO: 976952 - DNA, 25 bp, Mus musculus
tttgtttatggtgtgcagatggcct

SEQ ID NO: 976953 - DNA, 25 bp, Mus musculus
tttgtttatttgatctctttttcag

SEQ ID NO: 976954 - DNA, 25 bp, Mus musculus
tttgtttatttgttctctttttcag

SEQ ID NO: 976955 - DNA, 25 bp, Mus musculus
tttgtttcaaatcgccgagtctccc

SEQ ID NO: 976956 - DNA, 25 bp, Mus musculus
tttgtttcaaatggccgagtctccc

SEQ ID NO: 976957 - DNA, 25 bp, Mus musculus
tttgtttcacagacagatgcatttg

SEQ ID NO: 976958 - DNA, 25 bp, Mus musculus
tttgtttcacagtcagatgcatttg

SEQ ID NO: 976959 - DNA, 25 bp, Mus musculus
tttgtttcacctctcaatatatcag

SEQ ID NO: 976960 - DNA, 25 bp, Mus musculus
tttgtttcacctgtcaatatatcag

SEQ ID NO: 976961 - DNA, 25 bp, Mus musculus
tttgtttcagggatagcgttcagtt

SEQ ID NO: 976962 - DNA, 25 bp, Mus musculus
tttgtttcagggttagcgttcagtt

SEQ ID NO: 976963 - DNA, 25 bp, Mus musculus
tttgtttcatcactcctcggaggtc

SEQ ID NO: 976964 - DNA, 25 bp, Mus musculus
tttgtttcatcagtcctcggaggtc

SEQ ID NO: 976965 - DNA, 25 bp, Mus musculus
tttgtttccacaaggccttttcctg

SEQ ID NO: 976966 - DNA, 25 bp, Mus musculus
tttgtttccacatggccttttcctg

SEQ ID NO: 976967 - DNA, 25 bp, Mus musculus
tttgtttcccctccatttcttatca

SEQ ID NO: 976968 - DNA, 25 bp, Mus musculus
tttgtttcccctgcatttcttatca

SEQ ID NO: 976969 - DNA, 25 bp, Mus musculus
tttgtttcccgacatactgtaaaga

SEQ ID NO: 976970 - DNA, 25 bp, Mus musculus
tttgtttcccgagatactgtaaaga

SEQ ID NO: 976971 - DNA, 25 bp, Mus musculus
tttgtttcctcactctgtgtacttg

SEQ ID NO: 976972 - DNA, 25 bp, Mus musculus
tttgtttcctcagtctgtgtacttg

SEQ ID NO: 976973 - DNA, 25 bp, Mus musculus
tttgtttcctccaaaacttatgctg

SEQ ID NO: 976974 - DNA, 25 bp, Mus musculus
tttgtttcctccagtggatgtgaga

SEQ ID NO: 976975 - DNA, 25 bp, Mus musculus
tttgtttcctcctaaacttatgctg

SEQ ID NO: 976976 - DNA, 25 bp, Mus musculus
tttgtttcctcctgtggatgtgaga

SEQ ID NO: 976977 - DNA, 25 bp, Mus musculus
tttgtttcctctcagtctttgacct

SEQ ID NO: 976978 - DNA, 25 bp, Mus musculus
tttgtttcctctctatcagagtatg

SEQ ID NO: 976979 - DNA, 25 bp, Mus musculus
tttgtttcctctgagtctttgacct

SEQ ID NO: 976980 - DNA, 25 bp, Mus musculus
tttgtttcctctgtatcagagtatg

SEQ ID NO: 976981 - DNA, 25 bp, Mus musculus
tttgtttccttgacgggtcagcaaa

SEQ ID NO: 976982 - DNA, 25 bp, Mus musculus
tttgtttccttgtcgggtcagcaaa

SEQ ID NO: 976983 - DNA, 25 bp, Mus musculus
tttgtttcctttacccagcaagaat

SEQ ID NO: 976984 - DNA, 25 bp, Mus musculus
tttgtttcctttccacagctagaaa

SEQ ID NO: 976985 - DNA, 25 bp, Mus musculus
tttgtttcctttgcacagctagaaa

SEQ ID NO: 976986 - DNA, 25 bp, Mus musculus
tttgtttccttttcccagcaagaat

SEQ ID NO: 976987 - DNA, 25 bp, Mus musculus
tttgtttcgcagcttgctcagacta

SEQ ID NO: 976988 - DNA, 25 bp, Mus musculus
tttgtttcgcaggttgctcagacta

SEQ ID NO: 976989 - DNA, 25 bp, Mus musculus
tttgtttctcccataatctttccat

SEQ ID NO: 976990 - DNA, 25 bp, Mus musculus
tttgtttctcccttaatctttccat

SEQ ID NO: 976991 - DNA, 25 bp, Mus musculus
tttgtttctctcatggactgttgga

SEQ ID NO: 976992 - DNA, 25 bp, Mus musculus
tttgtttctctcttggactgttgga

SEQ ID NO: 976993 - DNA, 25 bp, Mus musculus
tttgtttctctgattggcagccagg

SEQ ID NO: 976994 - DNA, 25 bp, Mus musculus
tttgtttctctgtttggcagccagg

SEQ ID NO: 976995 - DNA, 25 bp, Mus musculus
tttgtttcttagcactgtcgctcaa

SEQ ID NO: 976996 - DNA, 25 bp, Mus musculus
tttgtttcttaggactgtcgctcaa

SEQ ID NO: 976997 - DNA, 25 bp, Mus musculus
tttgtttcttccctatctgctgtat

SEQ ID NO: 976998 - DNA, 25 bp, Mus musculus
tttgtttcttccgtatctgctgtat

SEQ ID NO: 976999 - DNA, 25 bp, Mus musculus
tttgtttcttctccgaccacagcta

SEQ ID NO: 977000 - DNA, 25 bp, Mus musculus
tttgtttcttctgcgaccacagcta

SEQ ID NO: 977001 - DNA, 25 bp, Mus musculus
tttgtttgacataagagcacagcac

SEQ ID NO: 977002 - DNA, 25 bp, Mus musculus
tttgtttgacattagagcacagcac

SEQ ID NO: 977003 - DNA, 25 bp, Mus musculus
tttgtttgaggcattgtctcacctg

SEQ ID NO: 977004 - DNA, 25 bp, Mus musculus
tttgtttgaggctttgtctcacctg

SEQ ID NO: 977005 - DNA, 25 bp, Mus musculus
tttgtttgccccagggatgccacat

SEQ ID NO: 977006 - DNA, 25 bp, Mus musculus
tttgtttgcccctgggatgccacat

SEQ ID NO: 977007 - DNA, 25 bp, Mus musculus
tttgtttgcctcattgctcctttgt

SEQ ID NO: 977008 - DNA, 25 bp, Mus musculus
tttgtttgcctctttgctcctttgt

SEQ ID NO: 977009 - DNA, 25 bp, Mus musculus
tttgtttgctaaacacgtgtgccca

SEQ ID NO: 977010 - DNA, 25 bp, Mus musculus
tttgtttgctaatcacgtgtgccca

SEQ ID NO: 977011 - DNA, 25 bp, Mus musculus
tttgtttgcttcactgggacagtat

SEQ ID NO: 977012 - DNA, 25 bp, Mus musculus
tttgtttgcttctctgggacagtat

SEQ ID NO: 977013 - DNA, 25 bp, Mus musculus
tttgtttggcagaaagggctttatc

SEQ ID NO: 977014 - DNA, 25 bp, Mus musculus
tttgtttggcagtaagggctttatc

SEQ ID NO: 977015 - DNA, 25 bp, Mus musculus
tttgtttgtattatcccactggaag

SEQ ID NO: 977016 - DNA, 25 bp, Mus musculus
tttgtttgtattttcccactggaag

SEQ ID NO: 977017 - DNA, 25 bp, Mus musculus
tttgtttgtcacattctggagccct

SEQ ID NO: 977018 - DNA, 25 bp, Mus musculus
tttgtttgtcactttctggagccct

SEQ ID NO: 977019 - DNA, 25 bp, Mus musculus
tttgtttgtttcacagaacctgggt

SEQ ID NO: 977020 - DNA, 25 bp, Mus musculus
tttgtttgtttcacaggcccttcca

SEQ ID NO: 977021 - DNA, 25 bp, Mus musculus
tttgtttgtttctcagaacctgggt

SEQ ID NO: 977022 - DNA, 25 bp, Mus musculus
tttgtttgtttctcaggcccttcca

SEQ ID NO: 977023 - DNA, 25 bp, Mus musculus
tttgttttaatgctctgtccctaag

SEQ ID NO: 977024 - DNA, 25 bp, Mus musculus
tttgttttaatggtctgtccctaag

SEQ ID NO: 977025 - DNA, 25 bp, Mus musculus
tttgttttacttctaagatgggatc

SEQ ID NO: 977026 - DNA, 25 bp, Mus musculus
tttgttttacttgtaagatgggatc

SEQ ID NO: 977027 - DNA, 25 bp, Mus musculus
tttgttttagctcttctctggttta

SEQ ID NO: 977028 - DNA, 25 bp, Mus musculus
tttgttttagctgttctctggttta

SEQ ID NO: 977029 - DNA, 25 bp, Mus musculus
tttgttttcacaatcctctgttatt

SEQ ID NO: 977030 - DNA, 25 bp, Mus musculus
tttgttttcacattcctctgttatt

SEQ ID NO: 977031 - DNA, 25 bp, Mus musculus
tttgttttcattcagactcttgttc

SEQ ID NO: 977032 - DNA, 25 bp, Mus musculus
tttgttttcattgagactcttgttc

SEQ ID NO: 977033 - DNA, 25 bp, Mus musculus
tttgttttccaaagatgtgtatttg

SEQ ID NO: 977034 - DNA, 25 bp, Mus musculus
tttgttttccaatgatgtgtatttg

SEQ ID NO: 977035 - DNA, 25 bp, Mus musculus
tttgttttccaccacgcgctgataa

SEQ ID NO: 977036 - DNA, 25 bp, Mus musculus
tttgttttccacgacgcgctgataa

SEQ ID NO: 977037 - DNA, 25 bp, Mus musculus
tttgttttccatcctaaagctaagt

SEQ ID NO: 977038 - DNA, 25 bp, Mus musculus
tttgttttccatgctaaagctaagt

SEQ ID NO: 977039 - DNA, 25 bp, Mus musculus
tttgttttccttccaagccagtcac

SEQ ID NO: 977040 - DNA, 25 bp, Mus musculus
tttgttttccttgcaagccagtcac

SEQ ID NO: 977041 - DNA, 25 bp, Mus musculus
tttgttttcgtccagtaattcctca

SEQ ID NO: 977042 - DNA, 25 bp, Mus musculus
tttgttttcgtcgagtaattcctca

SEQ ID NO: 977043 - DNA, 25 bp, Mus musculus
tttgttttcttaaccccactcagct

SEQ ID NO: 977044 - DNA, 25 bp, Mus musculus
tttgttttcttatccccactcagct

SEQ ID NO: 977045 - DNA, 25 bp, Mus musculus
tttgttttgcaacggcccatccaga

SEQ ID NO: 977046 - DNA, 25 bp, Mus musculus
tttgttttgcaagggcccatccaga

SEQ ID NO: 977047 - DNA, 25 bp, Mus musculus
tttgttttgcccaaccaagatggaa

SEQ ID NO: 977048 - DNA, 25 bp, Mus musculus
tttgttttgccctaccaagatggaa

SEQ ID NO: 977049 - DNA, 25 bp, Mus musculus
tttgttttgcctaccagaccaggaa

SEQ ID NO: 977050 - DNA, 25 bp, Mus musculus
tttgttttgccttccagaccaggaa

SEQ ID NO: 977051 - DNA, 25 bp, Mus musculus
tttgttttgctacacctaaaagaca

SEQ ID NO: 977052 - DNA, 25 bp, Mus musculus
tttgttttgctagacctaaaagaca

SEQ ID NO: 977053 - DNA, 25 bp, Mus musculus
tttgttttggtgatcctcgttctga

SEQ ID NO: 977054 - DNA, 25 bp, Mus musculus
tttgttttggtgttcctcgttctga

SEQ ID NO: 977055 - DNA, 25 bp, Mus musculus
tttgttttgtgtagccgtaaggtct

SEQ ID NO: 977056 - DNA, 25 bp, Mus musculus
tttgttttgtgttgccgtaaggtct

SEQ ID NO: 977057 - DNA, 25 bp, Mus musculus
tttgtttttaacagcgtcctcggat

SEQ ID NO: 977058 - DNA, 25 bp, Mus musculus
tttgtttttaactgcgtcctcggat

SEQ ID NO: 977059 - DNA, 25 bp, Mus musculus
tttgtttttaatccgcaccttacag

SEQ ID NO: 977060 - DNA, 25 bp, Mus musculus
tttgtttttaatgcgcaccttacag

SEQ ID NO: 977061 - DNA, 25 bp, Mus musculus
tttgtttttacacaagcccatggtc

SEQ ID NO: 977062 - DNA, 25 bp, Mus musculus
tttgtttttacagaagcccatggtc

SEQ ID NO: 977063 - DNA, 25 bp, Mus musculus
tttgtttttccaactgattcaggtg

SEQ ID NO: 977064 - DNA, 25 bp, Mus musculus
tttgtttttccatctgattcaggtg

SEQ ID NO: 977065 - DNA, 25 bp, Mus musculus
tttgtttttcctaatcgctgtgtga

SEQ ID NO: 977066 - DNA, 25 bp, Mus musculus
tttgtttttcctcaatgagaattca

SEQ ID NO: 977067 - DNA, 25 bp, Mus musculus
tttgtttttcctgaatgagaattca

SEQ ID NO: 977068 - DNA, 25 bp, Mus musculus
tttgtttttccttatcgctgtgtga

SEQ ID NO: 977069 - DNA, 25 bp, Mus musculus
tttgtttttctgcaggagctaacga

SEQ ID NO: 977070 - DNA, 25 bp, Mus musculus
tttgtttttctggaggagctaacga

SEQ ID NO: 977071 - DNA, 25 bp, Mus musculus
tttgtttttgagctgcactgagcag

SEQ ID NO: 977072 - DNA, 25 bp, Mus musculus
tttgtttttgaggtgcactgagcag

SEQ ID NO: 977073 - DNA, 25 bp, Mus musculus
tttgttttttcaagcggctcacagc

SEQ ID NO: 977074 - DNA, 25 bp, Mus musculus
tttgttttttcatgcggctcacagc

SEQ ID NO: 977075 - DNA, 25 bp, Mus musculus
tttgttttttgtacacagcatcata

SEQ ID NO: 977076 - DNA, 25 bp, Mus musculus
tttgttttttgtccctgccctcatt

SEQ ID NO: 977077 - DNA, 25 bp, Mus musculus
tttgttttttgtgcctgccctcatt

SEQ ID NO: 977078 - DNA, 25 bp, Mus musculus
tttgttttttgttcacagcatcata

SEQ ID NO: 977079 - DNA, 25 bp, Mus musculus
ttttaaaaaataccctctgacttct

SEQ ID NO: 977080 - DNA, 25 bp, Mus musculus
ttttaaaaaatagcctctgacttct

SEQ ID NO: 977081 - DNA, 25 bp, Mus musculus
ttttaaaaattgctggcaacactca

SEQ ID NO: 977082 - DNA, 25 bp, Mus musculus
ttttaaaaattggtggcaacactca

SEQ ID NO: 977083 - DNA, 25 bp, Mus musculus
ttttaaaaccccacgtgcagagtat

SEQ ID NO: 977084 - DNA, 25 bp, Mus musculus
ttttaaaacccctcgtgcagagtat

SEQ ID NO: 977085 - DNA, 25 bp, Mus musculus
ttttaaaactcacctgtcgctggac

SEQ ID NO: 977086 - DNA, 25 bp, Mus musculus
ttttaaaactcagctgtcgctggac

SEQ ID NO: 977087 - DNA, 25 bp, Mus musculus
ttttaaaactttcgccaagctctgg

SEQ ID NO: 977088 - DNA, 25 bp, Mus musculus
ttttaaaactttggccaagctctgg

SEQ ID NO: 977089 - DNA, 25 bp, Mus musculus
ttttaaaagcctcgaaatcacaaca

SEQ ID NO: 977090 - DNA, 25 bp, Mus musculus
ttttaaaagcctggaaatcacaaca

SEQ ID NO: 977091 - DNA, 25 bp, Mus musculus
ttttaaaagtgccactcactccctg

SEQ ID NO: 977092 - DNA, 25 bp, Mus musculus
ttttaaaagtgcgactcactccctg

SEQ ID NO: 977093 - DNA, 25 bp, Mus musculus
ttttaaaatgacacttcccagcaac

SEQ ID NO: 977094 - DNA, 25 bp, Mus musculus
ttttaaaatgactcttcccagcaac

SEQ ID NO: 977095 - DNA, 25 bp, Mus musculus
ttttaaacagctatgcttgtattgt

SEQ ID NO: 977096 - DNA, 25 bp, Mus musculus
ttttaaacagctttgcttgtattgt

SEQ ID NO: 977097 - DNA, 25 bp, Mus musculus
ttttaaacaggcagtctctttccga

SEQ ID NO: 977098 - DNA, 25 bp, Mus musculus
ttttaaacaggctgtctctttccga

SEQ ID NO: 977099 - DNA, 25 bp, Mus musculus
ttttaaaccaagctgtctggctgcc

SEQ ID NO: 977100 - DNA, 25 bp, Mus musculus
ttttaaaccaaggtgtctggctgcc

SEQ ID NO: 977101 - DNA, 25 bp, Mus musculus
ttttaaacccacaagaagatgtact

SEQ ID NO: 977102 - DNA, 25 bp, Mus musculus
ttttaaacccactagaagatgtact

SEQ ID NO: 977103 - DNA, 25 bp, Mus musculus
ttttaaaccgcaaaaagctccctct

SEQ ID NO: 977104 - DNA, 25 bp, Mus musculus
ttttaaaccgcataaagctccctct

SEQ ID NO: 977105 - DNA, 25 bp, Mus musculus
ttttaaacgacgactgtgccaccct

SEQ ID NO: 977106 - DNA, 25 bp, Mus musculus
ttttaaacgacgtctgtgccaccct

SEQ ID NO: 977107 - DNA, 25 bp, Mus musculus
ttttaaactcctacctgctgaaatt

SEQ ID NO: 977108 - DNA, 25 bp, Mus musculus
ttttaaactccttcctgctgaaatt

SEQ ID NO: 977109 - DNA, 25 bp, Mus musculus
ttttaaagacaacgcagggagtcga

SEQ ID NO: 977110 - DNA, 25 bp, Mus musculus
ttttaaagacaaggcagggagtcga

SEQ ID NO: 977111 - DNA, 25 bp, Mus musculus
ttttaaagagccacagtctgactga

SEQ ID NO: 977112 - DNA, 25 bp, Mus musculus
ttttaaagagcctcagtctgactga

SEQ ID NO: 977113 - DNA, 25 bp, Mus musculus
ttttaaagcaggctgccttctcctg

SEQ ID NO: 977114 - DNA, 25 bp, Mus musculus
ttttaaagcagggtgccttctcctg

SEQ ID NO: 977115 - DNA, 25 bp, Mus musculus
ttttaaagccatccctaaccaggta

SEQ ID NO: 977116 - DNA, 25 bp, Mus musculus
ttttaaagccatgcctaaccaggta

SEQ ID NO: 977117 - DNA, 25 bp, Mus musculus
ttttaaagctgacgtcttcgccctt

SEQ ID NO: 977118 - DNA, 25 bp, Mus musculus
ttttaaagctgaggtcttcgccctt

SEQ ID NO: 977119 - DNA, 25 bp, Mus musculus
ttttaaaggccaccccacacatggc

SEQ ID NO: 977120 - DNA, 25 bp, Mus musculus
ttttaaaggccagcccacacatggc

SEQ ID NO: 977121 - DNA, 25 bp, Mus musculus
ttttaaagggagacgtctaggctgg

SEQ ID NO: 977122 - DNA, 25 bp, Mus musculus
ttttaaagggagtcgtctaggctgg

SEQ ID NO: 977123 - DNA, 25 bp, Mus musculus
ttttaaagtaccatgcactgataaa

SEQ ID NO: 977124 - DNA, 25 bp, Mus musculus
ttttaaagtaccttgcactgataaa

SEQ ID NO: 977125 - DNA, 25 bp, Mus musculus
ttttaaagtccacaggatcagcctc

SEQ ID NO: 977126 - DNA, 25 bp, Mus musculus
ttttaaagtccagaggatcagcctc

SEQ ID NO: 977127 - DNA, 25 bp, Mus musculus
ttttaaagtgcacggtcattaccag

SEQ ID NO: 977128 - DNA, 25 bp, Mus musculus
ttttaaagtgcagggtcattaccag

SEQ ID NO: 977129 - DNA, 25 bp, Mus musculus
ttttaaagtgttcagccggagagct

SEQ ID NO: 977130 - DNA, 25 bp, Mus musculus
ttttaaagtgttgagccggagagct

SEQ ID NO: 977131 - DNA, 25 bp, Mus musculus
ttttaaataaaaccacctagttgtg

SEQ ID NO: 977132 - DNA, 25 bp, Mus musculus
ttttaaataaaagcacctagttgtg

SEQ ID NO: 977133 - DNA, 25 bp, Mus musculus
ttttaaatagcacggcttcctccac

SEQ ID NO: 977134 - DNA, 25 bp, Mus musculus
ttttaaatagcagggcttcctccac

SEQ ID NO: 977135 - DNA, 25 bp, Mus musculus
ttttaaatcaatcaagcccctctgg

SEQ ID NO: 977136 - DNA, 25 bp, Mus musculus
ttttaaatcaatgaagcccctctgg

SEQ ID NO: 977137 - DNA, 25 bp, Mus musculus
ttttaaatctctaatccttccttgt

SEQ ID NO: 977138 - DNA, 25 bp, Mus musculus
ttttaaatctcttatccttccttgt

SEQ ID NO: 977139 - DNA, 25 bp, Mus musculus
ttttaaatgcaaccctggtggttat

SEQ ID NO: 977140 - DNA, 25 bp, Mus musculus
ttttaaatgcaagcctggtggttat

SEQ ID NO: 977141 - DNA, 25 bp, Mus musculus
ttttaaatgcctctgcatcgcctac

SEQ ID NO: 977142 - DNA, 25 bp, Mus musculus
ttttaaatgcctgtgcatcgcctac

SEQ ID NO: 977143 - DNA, 25 bp, Mus musculus
ttttaaatgtccagtggcaagtcac

SEQ ID NO: 977144 - DNA, 25 bp, Mus musculus
ttttaaatgtcctgtggcaagtcac

SEQ ID NO: 977145 - DNA, 25 bp, Mus musculus
ttttaaattacacctgacatcacat

SEQ ID NO: 977146 - DNA, 25 bp, Mus musculus
ttttaaattacagctgacatcacat

SEQ ID NO: 977147 - DNA, 25 bp, Mus musculus
ttttaaattcccagtgatgtgtgtt

SEQ ID NO: 977148 - DNA, 25 bp, Mus musculus
ttttaaattccctgtgatgtgtgtt

SEQ ID NO: 977149 - DNA, 25 bp, Mus musculus
ttttaaattgttaggactacttgag

SEQ ID NO: 977150 - DNA, 25 bp, Mus musculus
ttttaaattgtttggactacttgag

SEQ ID NO: 977151 - DNA, 25 bp, Mus musculus
ttttaaatttcaacacctggataag

SEQ ID NO: 977152 - DNA, 25 bp, Mus musculus
ttttaaatttcatcacctggataag

SEQ ID NO: 977153 - DNA, 25 bp, Mus musculus
ttttaacaaccgactccatatctga

SEQ ID NO: 977154 - DNA, 25 bp, Mus musculus
ttttaacaaccgtctccatatctga

SEQ ID NO: 977155 - DNA, 25 bp, Mus musculus
ttttaacaaggtccccaggtcagac

SEQ ID NO: 977156 - DNA, 25 bp, Mus musculus
ttttaacaaggtgcccaggtcagac

SEQ ID NO: 977157 - DNA, 25 bp, Mus musculus
ttttaacacataccactctgttgta

SEQ ID NO: 977158 - DNA, 25 bp, Mus musculus
ttttaacacatagcactctgttgta

SEQ ID NO: 977159 - DNA, 25 bp, Mus musculus
ttttaacagactacctcatttccct

SEQ ID NO: 977160 - DNA, 25 bp, Mus musculus
ttttaacagacttcctcatttccct

SEQ ID NO: 977161 - DNA, 25 bp, Mus musculus
ttttaacagcagcttgtccccagta

SEQ ID NO: 977162 - DNA, 25 bp, Mus musculus
ttttaacagcaggttgtccccagta

SEQ ID NO: 977163 - DNA, 25 bp, Mus musculus
ttttaacatgatcgcctcacagcag

SEQ ID NO: 977164 - DNA, 25 bp, Mus musculus
ttttaacatgatggcctcacagcag

SEQ ID NO: 977165 - DNA, 25 bp, Mus musculus
ttttaaccagacattctcaggcctc

SEQ ID NO: 977166 - DNA, 25 bp, Mus musculus
ttttaaccagactttctcaggcctc

SEQ ID NO: 977167 - DNA, 25 bp, Mus musculus
ttttaaccatcacccaacccctgct

SEQ ID NO: 977168 - DNA, 25 bp, Mus musculus
ttttaaccatcagccaacccctgct

SEQ ID NO: 977169 - DNA, 25 bp, Mus musculus
ttttaacccaccaggcttcacacaa

SEQ ID NO: 977170 - DNA, 25 bp, Mus musculus
ttttaacccacctggcttcacacaa

SEQ ID NO: 977171 - DNA, 25 bp, Mus musculus
ttttaacccattcattcttagtgtg

SEQ ID NO: 977172 - DNA, 25 bp, Mus musculus
ttttaacccattgattcttagtgtg

SEQ ID NO: 977173 - DNA, 25 bp, Mus musculus
ttttaaccccagagagaacctgcac

SEQ ID NO: 977174 - DNA, 25 bp, Mus musculus
ttttaaccccagtgagaacctgcac

SEQ ID NO: 977175 - DNA, 25 bp, Mus musculus
ttttaacccggccttctcaggatga

SEQ ID NO: 977176 - DNA, 25 bp, Mus musculus
ttttaacccggcgttctcaggatga

SEQ ID NO: 977177 - DNA, 25 bp, Mus musculus
ttttaacctatgagtacctcacgag

SEQ ID NO: 977178 - DNA, 25 bp, Mus musculus
ttttaacctatgtgtacctcacgag

SEQ ID NO: 977179 - DNA, 25 bp, Mus musculus
ttttaacgtcgtagatctgttttga

SEQ ID NO: 977180 - DNA, 25 bp, Mus musculus
ttttaacgtcgttgatctgttttga

SEQ ID NO: 977181 - DNA, 25 bp, Mus musculus
ttttaactacttaggactggatcat

SEQ ID NO: 977182 - DNA, 25 bp, Mus musculus
ttttaactactttggactggatcat

SEQ ID NO: 977183 - DNA, 25 bp, Mus musculus
ttttaactagtcatggcatgtcttt

SEQ ID NO: 977184 - DNA, 25 bp, Mus musculus
ttttaactagtcttggcatgtcttt

SEQ ID NO: 977185 - DNA, 25 bp, Mus musculus
ttttaactcagtcttttctgtcctg

SEQ ID NO: 977186 - DNA, 25 bp, Mus musculus
ttttaactcagtgttttctgtcctg

SEQ ID NO: 977187 - DNA, 25 bp, Mus musculus
ttttaactctttcctgactttgatg

SEQ ID NO: 977188 - DNA, 25 bp, Mus musculus
ttttaactctttcgctgaagtgatc

SEQ ID NO: 977189 - DNA, 25 bp, Mus musculus
ttttaactctttgctgactttgatg

SEQ ID NO: 977190 - DNA, 25 bp, Mus musculus
ttttaactctttggctgaagtgatc

SEQ ID NO: 977191 - DNA, 25 bp, Mus musculus
ttttaactggaacagttctctaact

SEQ ID NO: 977192 - DNA, 25 bp, Mus musculus
ttttaactggaagagttctctaact

SEQ ID NO: 977193 - DNA, 25 bp, Mus musculus
ttttaactgggcagagctggctctc

SEQ ID NO: 977194 - DNA, 25 bp, Mus musculus
ttttaactgggctgagctggctctc

SEQ ID NO: 977195 - DNA, 25 bp, Mus musculus
ttttaacttcttcatgtgtgggcat

SEQ ID NO: 977196 - DNA, 25 bp, Mus musculus
ttttaacttcttgatgtgtgggcat

SEQ ID NO: 977197 - DNA, 25 bp, Mus musculus
ttttaagaagccactacctcctact

SEQ ID NO: 977198 - DNA, 25 bp, Mus musculus
ttttaagaagcctctacctcctact

SEQ ID NO: 977199 - DNA, 25 bp, Mus musculus
ttttaagaatagcttttctgctgaa

SEQ ID NO: 977200 - DNA, 25 bp, Mus musculus
ttttaagaataggttttctgctgaa

SEQ ID NO: 977201 - DNA, 25 bp, Mus musculus
ttttaagacagcctcagtgatccca

SEQ ID NO: 977202 - DNA, 25 bp, Mus musculus
ttttaagacagcgtcagtgatccca

SEQ ID NO: 977203 - DNA, 25 bp, Mus musculus
ttttaagacagtatcccaagccttg

SEQ ID NO: 977204 - DNA, 25 bp, Mus musculus
ttttaagacagtttcccaagccttg

SEQ ID NO: 977205 - DNA, 25 bp, Mus musculus
ttttaagactgaattccagagtatc

SEQ ID NO: 977206 - DNA, 25 bp, Mus musculus
ttttaagactgacaaggccggtggt

SEQ ID NO: 977207 - DNA, 25 bp, Mus musculus
ttttaagactgagaaggccggtggt

SEQ ID NO: 977208 - DNA, 25 bp, Mus musculus
ttttaagactgatttccagagtatc

SEQ ID NO: 977209 - DNA, 25 bp, Mus musculus
ttttaagacttcacccaaagctctg

SEQ ID NO: 977210 - DNA, 25 bp, Mus musculus
ttttaagacttctcccaaagctctg

SEQ ID NO: 977211 - DNA, 25 bp, Mus musculus
ttttaagatcttactgccctttcct

SEQ ID NO: 977212 - DNA, 25 bp, Mus musculus
ttttaagatctttctgccctttcct

SEQ ID NO: 977213 - DNA, 25 bp, Mus musculus
ttttaagcacataaggagtcactct

SEQ ID NO: 977214 - DNA, 25 bp, Mus musculus
ttttaagcacattaggagtcactct

SEQ ID NO: 977215 - DNA, 25 bp, Mus musculus
ttttaagcacccagtctaacgctga

SEQ ID NO: 977216 - DNA, 25 bp, Mus musculus
ttttaagcaccctgtctaacgctga

SEQ ID NO: 977217 - DNA, 25 bp, Mus musculus
ttttaagcactccttcagttttctc

SEQ ID NO: 977218 - DNA, 25 bp, Mus musculus
ttttaagcactcgttcagttttctc

SEQ ID NO: 977219 - DNA, 25 bp, Mus musculus
ttttaagcagcaacacccagcagct

SEQ ID NO: 977220 - DNA, 25 bp, Mus musculus
ttttaagcagcatcacccagcagct

SEQ ID NO: 977221 - DNA, 25 bp, Mus musculus
ttttaagcatgtaggaaaggaggcc

SEQ ID NO: 977222 - DNA, 25 bp, Mus musculus
ttttaagcatgttggaaaggaggcc

SEQ ID NO: 977223 - DNA, 25 bp, Mus musculus
ttttaagccatactcctttcatcgg

SEQ ID NO: 977224 - DNA, 25 bp, Mus musculus
ttttaagccatagtcctttcatcgg

SEQ ID NO: 977225 - DNA, 25 bp, Mus musculus
ttttaagccggtaccacagcaactt

SEQ ID NO: 977226 - DNA, 25 bp, Mus musculus
ttttaagccggttccacagcaactt

SEQ ID NO: 977227 - DNA, 25 bp, Mus musculus
ttttaagccgtgacctgaagtcata

SEQ ID NO: 977228 - DNA, 25 bp, Mus musculus
ttttaagccgtgtcctgaagtcata

SEQ ID NO: 977229 - DNA, 25 bp, Mus musculus
ttttaagccttaactcgccattgat

SEQ ID NO: 977230 - DNA, 25 bp, Mus musculus
ttttaagccttatctcgccattgat

SEQ ID NO: 977231 - DNA, 25 bp, Mus musculus
ttttaagctgccagtgatatgtcca

SEQ ID NO: 977232 - DNA, 25 bp, Mus musculus
ttttaagctgcctgtgatatgtcca

SEQ ID NO: 977233 - DNA, 25 bp, Mus musculus
ttttaagcttttagaaaccactgag

SEQ ID NO: 977234 - DNA, 25 bp, Mus musculus
ttttaagctttttgaaaccactgag

SEQ ID NO: 977235 - DNA, 25 bp, Mus musculus
ttttaaggaggcagttggtactgtg

SEQ ID NO: 977236 - DNA, 25 bp, Mus musculus
ttttaaggaggctgttggtactgtg

SEQ ID NO: 977237 - DNA, 25 bp, Mus musculus
ttttaaggcccacaccaggtgtggg

SEQ ID NO: 977238 - DNA, 25 bp, Mus musculus
ttttaaggcccagaccaggtgtggg

SEQ ID NO: 977239 - DNA, 25 bp, Mus musculus
ttttaaggctgaaatctgtgggtaa

SEQ ID NO: 977240 - DNA, 25 bp, Mus musculus
ttttaaggctgatatctgtgggtaa

SEQ ID NO: 977241 - DNA, 25 bp, Mus musculus
ttttaagggactctctccaggttgt

SEQ ID NO: 977242 - DNA, 25 bp, Mus musculus
ttttaagggactgtctccaggttgt

SEQ ID NO: 977243 - DNA, 25 bp, Mus musculus
ttttaaggtaaacttgagcactcta

SEQ ID NO: 977244 - DNA, 25 bp, Mus musculus
ttttaaggtaaagttgagcactcta

SEQ ID NO: 977245 - DNA, 25 bp, Mus musculus
ttttaaggtgaaccccatgattagc

SEQ ID NO: 977246 - DNA, 25 bp, Mus musculus
ttttaaggtgaagcccatgattagc

SEQ ID NO: 977247 - DNA, 25 bp, Mus musculus
ttttaaggttctctgtcctggttgg

SEQ ID NO: 977248 - DNA, 25 bp, Mus musculus
ttttaaggttctgtgtcctggttgg

SEQ ID NO: 977249 - DNA, 25 bp, Mus musculus
ttttaaggttttctctgctcagcct

SEQ ID NO: 977250 - DNA, 25 bp, Mus musculus
ttttaaggttttgtctgctcagcct

SEQ ID NO: 977251 - DNA, 25 bp, Mus musculus
ttttaagtactactgcagggctgga

SEQ ID NO: 977252 - DNA, 25 bp, Mus musculus
ttttaagtactagtgcagggctgga

SEQ ID NO: 977253 - DNA, 25 bp, Mus musculus
ttttaagtatgactgctctacctgc

SEQ ID NO: 977254 - DNA, 25 bp, Mus musculus
ttttaagtatgagtgctctacctgc

SEQ ID NO: 977255 - DNA, 25 bp, Mus musculus
ttttaagtatgtcgtcatgttccat

SEQ ID NO: 977256 - DNA, 25 bp, Mus musculus
ttttaagtatgtggtcatgttccat

SEQ ID NO: 977257 - DNA, 25 bp, Mus musculus
ttttaagtcacactagttcctaagt

SEQ ID NO: 977258 - DNA, 25 bp, Mus musculus
ttttaagtcacagtagttcctaagt

SEQ ID NO: 977259 - DNA, 25 bp, Mus musculus
ttttaagtcacccttccctttgatg

SEQ ID NO: 977260 - DNA, 25 bp, Mus musculus
ttttaagtcaccgttccctttgatg

SEQ ID NO: 977261 - DNA, 25 bp, Mus musculus
ttttaagtccaaacagaaggtctga

SEQ ID NO: 977262 - DNA, 25 bp, Mus musculus
ttttaagtccaatcagaaggtctga

SEQ ID NO: 977263 - DNA, 25 bp, Mus musculus
ttttaagtctccctaacttcagctt

SEQ ID NO: 977264 - DNA, 25 bp, Mus musculus
ttttaagtctccgtaacttcagctt

SEQ ID NO: 977265 - DNA, 25 bp, Mus musculus
ttttaagtgagtcctgccttgccat

SEQ ID NO: 977266 - DNA, 25 bp, Mus musculus
ttttaagtgagtgctgccttgccat

SEQ ID NO: 977267 - DNA, 25 bp, Mus musculus
ttttaagtgcaacctgtgggatgaa

SEQ ID NO: 977268 - DNA, 25 bp, Mus musculus
ttttaagtgcaagctgtgggatgaa

SEQ ID NO: 977269 - DNA, 25 bp, Mus musculus
ttttaagtggcccaggatgtcctga

SEQ ID NO: 977270 - DNA, 25 bp, Mus musculus
ttttaagtggccgaggatgtcctga

SEQ ID NO: 977271 - DNA, 25 bp, Mus musculus
ttttaagtgtataccagagccgtac

SEQ ID NO: 977272 - DNA, 25 bp, Mus musculus
ttttaagtgtattccagagccgtac

SEQ ID NO: 977273 - DNA, 25 bp, Mus musculus
ttttaagttcccactctgtgaagag

SEQ ID NO: 977274 - DNA, 25 bp, Mus musculus
ttttaagttccctctctgtgaagag

SEQ ID NO: 977275 - DNA, 25 bp, Mus musculus
ttttaagttgctagtcctcagagtg

SEQ ID NO: 977276 - DNA, 25 bp, Mus musculus
ttttaagttgcttgtcctcagagtg

SEQ ID NO: 977277 - DNA, 25 bp, Mus musculus
ttttaagttgttcggtccactgagg

SEQ ID NO: 977278 - DNA, 25 bp, Mus musculus
ttttaagttgttgggtccactgagg

SEQ ID NO: 977279 - DNA, 25 bp, Mus musculus
ttttaataactcctccgctaatggg

SEQ ID NO: 977280 - DNA, 25 bp, Mus musculus
ttttaataactcgtccgctaatggg

SEQ ID NO: 977281 - DNA, 25 bp, Mus musculus
ttttaataagcaacatagaatccat

SEQ ID NO: 977282 - DNA, 25 bp, Mus musculus
ttttaataagcatcatagaatccat

SEQ ID NO: 977283 - DNA, 25 bp, Mus musculus
ttttaatagaacaccgcagccgact

SEQ ID NO: 977284 - DNA, 25 bp, Mus musculus
ttttaatagaactccgcagccgact

SEQ ID NO: 977285 - DNA, 25 bp, Mus musculus
ttttaatatcacagccccttggaac

SEQ ID NO: 977286 - DNA, 25 bp, Mus musculus
ttttaatatcacctccttgggctcc

SEQ ID NO: 977287 - DNA, 25 bp, Mus musculus
ttttaatatcacgtccttgggctcc

SEQ ID NO: 977288 - DNA, 25 bp, Mus musculus
ttttaatatcactgccccttggaac

SEQ ID NO: 977289 - DNA, 25 bp, Mus musculus
ttttaatattatatgtgtctgtgta

SEQ ID NO: 977290 - DNA, 25 bp, Mus musculus
ttttaatattatttgtgtctgtgta

SEQ ID NO: 977291 - DNA, 25 bp, Mus musculus
ttttaatccaagcacctcggaagct

SEQ ID NO: 977292 - DNA, 25 bp, Mus musculus
ttttaatccaaggacctcggaagct

SEQ ID NO: 977293 - DNA, 25 bp, Mus musculus
ttttaatccaccagggaagtgagct

SEQ ID NO: 977294 - DNA, 25 bp, Mus musculus
ttttaatccacctgggaagtgagct

SEQ ID NO: 977295 - DNA, 25 bp, Mus musculus
ttttaatccaggagctggtttgcca

SEQ ID NO: 977296 - DNA, 25 bp, Mus musculus
ttttaatccaggtgctggtttgcca

SEQ ID NO: 977297 - DNA, 25 bp, Mus musculus
ttttaatcctataagccaggcatgg

SEQ ID NO: 977298 - DNA, 25 bp, Mus musculus
ttttaatcctattagccaggcatgg

SEQ ID NO: 977299 - DNA, 25 bp, Mus musculus
ttttaatctcggctgtgaccccctg

SEQ ID NO: 977300 - DNA, 25 bp, Mus musculus
ttttaatctcgggtgtgaccccctg

SEQ ID NO: 977301 - DNA, 25 bp, Mus musculus
ttttaatctcttcctgaacccttgt

SEQ ID NO: 977302 - DNA, 25 bp, Mus musculus
ttttaatctcttgctgaacccttgt

SEQ ID NO: 977303 - DNA, 25 bp, Mus musculus
ttttaatgagcactggccagcttcc

SEQ ID NO: 977304 - DNA, 25 bp, Mus musculus
ttttaatgagcagtggccagcttcc

SEQ ID NO: 977305 - DNA, 25 bp, Mus musculus
ttttaatgcagcagtggactgaggt

SEQ ID NO: 977306 - DNA, 25 bp, Mus musculus
ttttaatgcagctgtggactgaggt

SEQ ID NO: 977307 - DNA, 25 bp, Mus musculus
ttttaatgctgactgcatttcttgt

SEQ ID NO: 977308 - DNA, 25 bp, Mus musculus
ttttaatgctgagtgcatttcttgt

SEQ ID NO: 977309 - DNA, 25 bp, Mus musculus
ttttaatgcttgcacttcattgttt

SEQ ID NO: 977310 - DNA, 25 bp, Mus musculus
ttttaatgcttggacttcattgttt

SEQ ID NO: 977311 - DNA, 25 bp, Mus musculus
ttttaatgggtgatatgcatacata

SEQ ID NO: 977312 - DNA, 25 bp, Mus musculus
ttttaatgggtgttatgcatacata

SEQ ID NO: 977313 - DNA, 25 bp, Mus musculus
ttttaatgtaacaccacaccccatg

SEQ ID NO: 977314 - DNA, 25 bp, Mus musculus
ttttaatgtaactccacaccccatg

SEQ ID NO: 977315 - DNA, 25 bp, Mus musculus
ttttaatgtattctctctatctact

SEQ ID NO: 977316 - DNA, 25 bp, Mus musculus
ttttaatgtattgtctctatctact

SEQ ID NO: 977317 - DNA, 25 bp, Mus musculus
ttttaatgtcccatctagtccagca

SEQ ID NO: 977318 - DNA, 25 bp, Mus musculus
ttttaatgtcccttctagtccagca

SEQ ID NO: 977319 - DNA, 25 bp, Mus musculus
ttttaatgttgtaccttgtgttgtg

SEQ ID NO: 977320 - DNA, 25 bp, Mus musculus
ttttaatgttgttccttgtgttgtg

SEQ ID NO: 977321 - DNA, 25 bp, Mus musculus
ttttaattcattatcgcctcttcct

SEQ ID NO: 977322 - DNA, 25 bp, Mus musculus
ttttaattcattttcgcctcttcct

SEQ ID NO: 977323 - DNA, 25 bp, Mus musculus
ttttaattccttaggcatggttgcc

SEQ ID NO: 977324 - DNA, 25 bp, Mus musculus
ttttaattcctttggcatggttgcc

SEQ ID NO: 977325 - DNA, 25 bp, Mus musculus
ttttaattctctaggtaacctggct

SEQ ID NO: 977326 - DNA, 25 bp, Mus musculus
ttttaattctcttggtaacctggct

SEQ ID NO: 977327 - DNA, 25 bp, Mus musculus
ttttaattctgtagcatctttgccc

SEQ ID NO: 977328 - DNA, 25 bp, Mus musculus
ttttaattctgttgcatctttgccc

SEQ ID NO: 977329 - DNA, 25 bp, Mus musculus
ttttaattgtgtaccttcctgctgc

SEQ ID NO: 977330 - DNA, 25 bp, Mus musculus
ttttaattgtgttccttcctgctgc

SEQ ID NO: 977331 - DNA, 25 bp, Mus musculus
ttttaatttcagctgactgccaatt

SEQ ID NO: 977332 - DNA, 25 bp, Mus musculus
ttttaatttcaggtgactgccaatt

SEQ ID NO: 977333 - DNA, 25 bp, Mus musculus
ttttaatttcttcgccaatagtcac

SEQ ID NO: 977334 - DNA, 25 bp, Mus musculus
ttttaatttcttggccaatagtcac

SEQ ID NO: 977335 - DNA, 25 bp, Mus musculus
ttttaattttaccttgagcttgtga

SEQ ID NO: 977336 - DNA, 25 bp, Mus musculus
ttttaattttacgttgagcttgtga

SEQ ID NO: 977337 - DNA, 25 bp, Mus musculus
ttttaattttccacctgcttggctg

SEQ ID NO: 977338 - DNA, 25 bp, Mus musculus
ttttaattttcctcctgcttggctg

SEQ ID NO: 977339 - DNA, 25 bp, Mus musculus
ttttacaacagaaggacactagaat

SEQ ID NO: 977340 - DNA, 25 bp, Mus musculus
ttttacaacagatggacactagaat

SEQ ID NO: 977341 - DNA, 25 bp, Mus musculus
ttttacaacattcagcttcagcatt

SEQ ID NO: 977342 - DNA, 25 bp, Mus musculus
ttttacaacattgagcttcagcatt

SEQ ID NO: 977343 - DNA, 25 bp, Mus musculus
ttttacaacttgaactgcgttaatg

SEQ ID NO: 977344 - DNA, 25 bp, Mus musculus
ttttacaacttgtactgcgttaatg

SEQ ID NO: 977345 - DNA, 25 bp, Mus musculus
ttttacaagaacaccaatgggtctc

SEQ ID NO: 977346 - DNA, 25 bp, Mus musculus
ttttacaagaactccaatgggtctc

SEQ ID NO: 977347 - DNA, 25 bp, Mus musculus
ttttacaagtaaacagctgggctga

SEQ ID NO: 977348 - DNA, 25 bp, Mus musculus
ttttacaagtaatcagctgggctga

SEQ ID NO: 977349 - DNA, 25 bp, Mus musculus
ttttacaatccccaagacacatcag

SEQ ID NO: 977350 - DNA, 25 bp, Mus musculus
ttttacaatcccgaagacacatcag

SEQ ID NO: 977351 - DNA, 25 bp, Mus musculus
ttttacaatctacacacacgacaca

SEQ ID NO: 977352 - DNA, 25 bp, Mus musculus
ttttacaatctagacacacgacaca

SEQ ID NO: 977353 - DNA, 25 bp, Mus musculus
ttttacacaaggactttgctgcccc

SEQ ID NO: 977354 - DNA, 25 bp, Mus musculus
ttttacacaaggtctttgctgcccc

SEQ ID NO: 977355 - DNA, 25 bp, Mus musculus
ttttacacaggccaagggcgctccc

SEQ ID NO: 977356 - DNA, 25 bp, Mus musculus
ttttacacaggcgaagggcgctccc

SEQ ID NO: 977357 - DNA, 25 bp, Mus musculus
ttttacacattgaagaggtttgaac

SEQ ID NO: 977358 - DNA, 25 bp, Mus musculus
ttttacacattgtagaggtttgaac

SEQ ID NO: 977359 - DNA, 25 bp, Mus musculus
ttttacaccagaactcatccttttg

SEQ ID NO: 977360 - DNA, 25 bp, Mus musculus
ttttacaccagatctcatccttttg

SEQ ID NO: 977361 - DNA, 25 bp, Mus musculus
ttttacaccttcatttgacaatctt

SEQ ID NO: 977362 - DNA, 25 bp, Mus musculus
ttttacaccttcttttgacaatctt

SEQ ID NO: 977363 - DNA, 25 bp, Mus musculus
ttttacactagcatgtgcattactg

SEQ ID NO: 977364 - DNA, 25 bp, Mus musculus
ttttacactagcttgtgcattactg

SEQ ID NO: 977365 - DNA, 25 bp, Mus musculus
ttttacacttacacctcagcagaaa

SEQ ID NO: 977366 - DNA, 25 bp, Mus musculus
ttttacacttactcctcagcagaaa

SEQ ID NO: 977367 - DNA, 25 bp, Mus musculus
ttttacagaggaagttcccacctgc

SEQ ID NO: 977368 - DNA, 25 bp, Mus musculus
ttttacagaggatgttcccacctgc

SEQ ID NO: 977369 - DNA, 25 bp, Mus musculus
ttttacagattaagggtatgtgatt

SEQ ID NO: 977370 - DNA, 25 bp, Mus musculus
ttttacagattatgggtatgtgatt

SEQ ID NO: 977371 - DNA, 25 bp, Mus musculus
ttttacagcagtccctttaatgagc

SEQ ID NO: 977372 - DNA, 25 bp, Mus musculus
ttttacagcagtgcctttaatgagc

SEQ ID NO: 977373 - DNA, 25 bp, Mus musculus
ttttacagccataaatctcacatgt

SEQ ID NO: 977374 - DNA, 25 bp, Mus musculus
ttttacagccattaatctcacatgt

SEQ ID NO: 977375 - DNA, 25 bp, Mus musculus
ttttacagctgtcggtagttcggcg

SEQ ID NO: 977376 - DNA, 25 bp, Mus musculus
ttttacagctgtgggtagttcggcg

SEQ ID NO: 977377 - DNA, 25 bp, Mus musculus
ttttacagcttcaaacccatacctt

SEQ ID NO: 977378 - DNA, 25 bp, Mus musculus
ttttacagcttctaacccatacctt

SEQ ID NO: 977379 - DNA, 25 bp, Mus musculus
ttttacaggctaccccatgagtcgg

SEQ ID NO: 977380 - DNA, 25 bp, Mus musculus
ttttacaggctagcccatgagtcgg

SEQ ID NO: 977381 - DNA, 25 bp, Mus musculus
ttttacagtctccaaaatcgtctga

SEQ ID NO: 977382 - DNA, 25 bp, Mus musculus
ttttacagtctcgaaaatcgtctga

SEQ ID NO: 977383 - DNA, 25 bp, Mus musculus
ttttacagtggcatggctctatcta

SEQ ID NO: 977384 - DNA, 25 bp, Mus musculus
ttttacagtggcttggctctatcta

SEQ ID NO: 977385 - DNA, 25 bp, Mus musculus
ttttacagtgggaggctttgcccag

SEQ ID NO: 977386 - DNA, 25 bp, Mus musculus
ttttacagtgggtggctttgcccag

SEQ ID NO: 977387 - DNA, 25 bp, Mus musculus
ttttacagtgtgcacaaaggccagg

SEQ ID NO: 977388 - DNA, 25 bp, Mus musculus
ttttacagtgtggacaaaggccagg

SEQ ID NO: 977389 - DNA, 25 bp, Mus musculus
ttttacagtgttattccaaagagca

SEQ ID NO: 977390 - DNA, 25 bp, Mus musculus
ttttacagtgtttttccaaagagca

SEQ ID NO: 977391 - DNA, 25 bp, Mus musculus
ttttacagttcacagcattaacaaa

SEQ ID NO: 977392 - DNA, 25 bp, Mus musculus
ttttacagttcagagcattaacaaa

SEQ ID NO: 977393 - DNA, 25 bp, Mus musculus
ttttacatcagcactctctccttcg

SEQ ID NO: 977394 - DNA, 25 bp, Mus musculus
ttttacatcagctctctctccttcg

SEQ ID NO: 977395 - DNA, 25 bp, Mus musculus
ttttacatcagtcacctcattatac

SEQ ID NO: 977396 - DNA, 25 bp, Mus musculus
ttttacatcagtgacctcattatac

SEQ ID NO: 977397 - DNA, 25 bp, Mus musculus
ttttacatccacactgagacagaag

SEQ ID NO: 977398 - DNA, 25 bp, Mus musculus
ttttacatccactctgagacagaag

SEQ ID NO: 977399 - DNA, 25 bp, Mus musculus
ttttacatgttaattattcccttat

SEQ ID NO: 977400 - DNA, 25 bp, Mus musculus
ttttacatgttatttattcccttat

SEQ ID NO: 977401 - DNA, 25 bp, Mus musculus
ttttacattgtaccaaccagtctcc

SEQ ID NO: 977402 - DNA, 25 bp, Mus musculus
ttttacattgtagcaaccagtctcc

SEQ ID NO: 977403 - DNA, 25 bp, Mus musculus
ttttacattgtcaggcaatccacag

SEQ ID NO: 977404 - DNA, 25 bp, Mus musculus
ttttacattgtctggcaatccacag

SEQ ID NO: 977405 - DNA, 25 bp, Mus musculus
ttttacatttctcactttgagacta

SEQ ID NO: 977406 - DNA, 25 bp, Mus musculus
ttttacatttctgactttgagacta

SEQ ID NO: 977407 - DNA, 25 bp, Mus musculus
ttttaccaagtccatgtgtgaatga

SEQ ID NO: 977408 - DNA, 25 bp, Mus musculus
ttttaccaagtcgatgtgtgaatga

SEQ ID NO: 977409 - DNA, 25 bp, Mus musculus
ttttaccacaaaccctgcaacagtc

SEQ ID NO: 977410 - DNA, 25 bp, Mus musculus
ttttaccacaaagcctgcaacagtc

SEQ ID NO: 977411 - DNA, 25 bp, Mus musculus
ttttaccacaacatttgccaccaga

SEQ ID NO: 977412 - DNA, 25 bp, Mus musculus
ttttaccacaacttttgccaccaga

SEQ ID NO: 977413 - DNA, 25 bp, Mus musculus
ttttaccacacaatatagtctgcat

SEQ ID NO: 977414 - DNA, 25 bp, Mus musculus
ttttaccacacattatagtctgcat

SEQ ID NO: 977415 - DNA, 25 bp, Mus musculus
ttttaccaccatatggagtctccct

SEQ ID NO: 977416 - DNA, 25 bp, Mus musculus
ttttaccaccatttggagtctccct

SEQ ID NO: 977417 - DNA, 25 bp, Mus musculus
ttttaccactcccaaatgttttgtg

SEQ ID NO: 977418 - DNA, 25 bp, Mus musculus
ttttaccactccgaaatgttttgtg

SEQ ID NO: 977419 - DNA, 25 bp, Mus musculus
ttttaccactgactgctcgctccaa

SEQ ID NO: 977420 - DNA, 25 bp, Mus musculus
ttttaccactgagtgctcgctccaa

SEQ ID NO: 977421 - DNA, 25 bp, Mus musculus
ttttaccagatgatgcaaggactct

SEQ ID NO: 977422 - DNA, 25 bp, Mus musculus
ttttaccagatgttgcaaggactct

SEQ ID NO: 977423 - DNA, 25 bp, Mus musculus
ttttaccagggaactcctacagctg

SEQ ID NO: 977424 - DNA, 25 bp, Mus musculus
ttttaccagggatctcctacagctg

SEQ ID NO: 977425 - DNA, 25 bp, Mus musculus
ttttaccatcaaaattcctgggact

SEQ ID NO: 977426 - DNA, 25 bp, Mus musculus
ttttaccatcaatattcctgggact

SEQ ID NO: 977427 - DNA, 25 bp, Mus musculus
ttttacccacaaagaatctgatcaa

SEQ ID NO: 977428 - DNA, 25 bp, Mus musculus
ttttacccacaatgaatctgatcaa

SEQ ID NO: 977429 - DNA, 25 bp, Mus musculus
ttttacccactacttcaggattttg

SEQ ID NO: 977430 - DNA, 25 bp, Mus musculus
ttttacccactagttcaggattttg

SEQ ID NO: 977431 - DNA, 25 bp, Mus musculus
ttttacccagaaaggattcaggatc

SEQ ID NO: 977432 - DNA, 25 bp, Mus musculus
ttttacccagaatggattcaggatc

SEQ ID NO: 977433 - DNA, 25 bp, Mus musculus
ttttacccagagatgcacatggtta

SEQ ID NO: 977434 - DNA, 25 bp, Mus musculus
ttttacccagagttgcacatggtta

SEQ ID NO: 977435 - DNA, 25 bp, Mus musculus
ttttacccatggaggacacgtatct

SEQ ID NO: 977436 - DNA, 25 bp, Mus musculus
ttttacccatggtggacacgtatct

SEQ ID NO: 977437 - DNA, 25 bp, Mus musculus
ttttaccccataattagcctatact

SEQ ID NO: 977438 - DNA, 25 bp, Mus musculus
ttttaccccatatttagcctatact

SEQ ID NO: 977439 - DNA, 25 bp, Mus musculus
ttttaccccggtcatggaggcagtg

SEQ ID NO: 977440 - DNA, 25 bp, Mus musculus
ttttaccccggtgatggaggcagtg

SEQ ID NO: 977441 - DNA, 25 bp, Mus musculus
ttttacccgctgagctattcttttt

SEQ ID NO: 977442 - DNA, 25 bp, Mus musculus
ttttacccgctgtgctattcttttt

SEQ ID NO: 977443 - DNA, 25 bp, Mus musculus
ttttaccctcctcagtttatcactc

SEQ ID NO: 977444 - DNA, 25 bp, Mus musculus
ttttaccctcctgagtttatcactc

SEQ ID NO: 977445 - DNA, 25 bp, Mus musculus
ttttaccctctgcaaaacatgatgt

SEQ ID NO: 977446 - DNA, 25 bp, Mus musculus
ttttaccctctggaaaacatgatgt

SEQ ID NO: 977447 - DNA, 25 bp, Mus musculus
ttttaccgtatgcttcttacctgat

SEQ ID NO: 977448 - DNA, 25 bp, Mus musculus
ttttaccgtatggttcttacctgat

SEQ ID NO: 977449 - DNA, 25 bp, Mus musculus
ttttaccgtgataggcggcgacact

SEQ ID NO: 977450 - DNA, 25 bp, Mus musculus
ttttaccgtgattggcggcgacact

SEQ ID NO: 977451 - DNA, 25 bp, Mus musculus
ttttacctacacactcagttctata

SEQ ID NO: 977452 - DNA, 25 bp, Mus musculus
ttttacctacactctcagttctata

SEQ ID NO: 977453 - DNA, 25 bp, Mus musculus
ttttacctagaccagtggaccctga

SEQ ID NO: 977454 - DNA, 25 bp, Mus musculus
ttttacctagacgagtggaccctga

SEQ ID NO: 977455 - DNA, 25 bp, Mus musculus
ttttacctataacaatcacattttc

SEQ ID NO: 977456 - DNA, 25 bp, Mus musculus
ttttacctataagaatcacattttc

SEQ ID NO: 977457 - DNA, 25 bp, Mus musculus
ttttacctcagcaagtttccatgtt

SEQ ID NO: 977458 - DNA, 25 bp, Mus musculus
ttttacctcagctagtttccatgtt

SEQ ID NO: 977459 - DNA, 25 bp, Mus musculus
ttttacctcattacaagctgcacag

SEQ ID NO: 977460 - DNA, 25 bp, Mus musculus
ttttacctcatttcaagctgcacag

SEQ ID NO: 977461 - DNA, 25 bp, Mus musculus
ttttacctccagcagacccttagct

SEQ ID NO: 977462 - DNA, 25 bp, Mus musculus
ttttacctccaggagacccttagct

SEQ ID NO: 977463 - DNA, 25 bp, Mus musculus
ttttacctctaaaccatccaatctg

SEQ ID NO: 977464 - DNA, 25 bp, Mus musculus
ttttacctctaatccatccaatctg

SEQ ID NO: 977465 - DNA, 25 bp, Mus musculus
ttttacctgaccagcccattgctaa

SEQ ID NO: 977466 - DNA, 25 bp, Mus musculus
ttttacctgacctgcccattgctaa

SEQ ID NO: 977467 - DNA, 25 bp, Mus musculus
ttttacctgcagacatagcttgccc

SEQ ID NO: 977468 - DNA, 25 bp, Mus musculus
ttttacctgcagtcatagcttgccc

SEQ ID NO: 977469 - DNA, 25 bp, Mus musculus
ttttacctgtgcactatcgctatca

SEQ ID NO: 977470 - DNA, 25 bp, Mus musculus
ttttacctgtgctctatcgctatca

SEQ ID NO: 977471 - DNA, 25 bp, Mus musculus
ttttaccttgagcttgtgaagacag

SEQ ID NO: 977472 - DNA, 25 bp, Mus musculus
ttttaccttgaggttgtgaagacag

SEQ ID NO: 977473 - DNA, 25 bp, Mus musculus
ttttaccttgatcagctggcagctg

SEQ ID NO: 977474 - DNA, 25 bp, Mus musculus
ttttaccttgatgagctggcagctg

SEQ ID NO: 977475 - DNA, 25 bp, Mus musculus
ttttaccttgtcatgagattactgt

SEQ ID NO: 977476 - DNA, 25 bp, Mus musculus
ttttaccttgtcttgagattactgt

SEQ ID NO: 977477 - DNA, 25 bp, Mus musculus
ttttacctttccactacaagattag

SEQ ID NO: 977478 - DNA, 25 bp, Mus musculus
ttttacctttcctctacaagattag

SEQ ID NO: 977479 - DNA, 25 bp, Mus musculus
ttttacctttggctcctgaagccag

SEQ ID NO: 977480 - DNA, 25 bp, Mus musculus
ttttacctttgggtcctgaagccag

SEQ ID NO: 977481 - DNA, 25 bp, Mus musculus
ttttacgaagcacgacatccaggaa

SEQ ID NO: 977482 - DNA, 25 bp, Mus musculus
ttttacgaagcaggacatccaggaa

SEQ ID NO: 977483 - DNA, 25 bp, Mus musculus
ttttacgagcgcattgtgggtgaag

SEQ ID NO: 977484 - DNA, 25 bp, Mus musculus
ttttacgagcgctttgtgggtgaag

SEQ ID NO: 977485 - DNA, 25 bp, Mus musculus
ttttacgatgtgactagcctgggat

SEQ ID NO: 977486 - DNA, 25 bp, Mus musculus
ttttacgatgtgtctagcctgggat

SEQ ID NO: 977487 - DNA, 25 bp, Mus musculus
ttttacgccctcatgtgaatgttcg

SEQ ID NO: 977488 - DNA, 25 bp, Mus musculus
ttttacgccctcttgtgaatgttcg

SEQ ID NO: 977489 - DNA, 25 bp, Mus musculus
ttttacgctaaaagtgtttcacagg

SEQ ID NO: 977490 - DNA, 25 bp, Mus musculus
ttttacgctaaatgtgtttcacagg

SEQ ID NO: 977491 - DNA, 25 bp, Mus musculus
ttttacgcttatatttcatggatca

SEQ ID NO: 977492 - DNA, 25 bp, Mus musculus
ttttacgcttatttttcatggatca

SEQ ID NO: 977493 - DNA, 25 bp, Mus musculus
ttttacggccaaacgactcgacata

SEQ ID NO: 977494 - DNA, 25 bp, Mus musculus
ttttacggccaatcgactcgacata

SEQ ID NO: 977495 - DNA, 25 bp, Mus musculus
ttttacgttgcccaaacaagccatc

SEQ ID NO: 977496 - DNA, 25 bp, Mus musculus
ttttacgttgccgaaacaagccatc

SEQ ID NO: 977497 - DNA, 25 bp, Mus musculus
ttttactaagtgatcaactcttcaa

SEQ ID NO: 977498 - DNA, 25 bp, Mus musculus
ttttactaagtgttcaactcttcaa

SEQ ID NO: 977499 - DNA, 25 bp, Mus musculus
ttttactactttcctggcatggcag

SEQ ID NO: 977500 - DNA, 25 bp, Mus musculus
ttttactactttgctggcatggcag

SEQ ID NO: 977501 - DNA, 25 bp, Mus musculus
ttttactatagacccaaatctccag

SEQ ID NO: 977502 - DNA, 25 bp, Mus musculus
ttttactatagagccaaatctccag

SEQ ID NO: 977503 - DNA, 25 bp, Mus musculus
ttttactatcaaaccacctatgcag

SEQ ID NO: 977504 - DNA, 25 bp, Mus musculus
ttttactatcaatccacctatgcag

SEQ ID NO: 977505 - DNA, 25 bp, Mus musculus
ttttactcacatatgtttcctgcaa

SEQ ID NO: 977506 - DNA, 25 bp, Mus musculus
ttttactcacatttgtttcctgcaa

SEQ ID NO: 977507 - DNA, 25 bp, Mus musculus
ttttactcacctaaatctgtgggag

SEQ ID NO: 977508 - DNA, 25 bp, Mus musculus
ttttactcaccttaatctgtgggag

SEQ ID NO: 977509 - DNA, 25 bp, Mus musculus
ttttactcagatctccttgcttatg

SEQ ID NO: 977510 - DNA, 25 bp, Mus musculus
ttttactcagatgtccttgcttatg

SEQ ID NO: 977511 - DNA, 25 bp, Mus musculus
ttttactcatttcccagataacaag

SEQ ID NO: 977512 - DNA, 25 bp, Mus musculus
ttttactcatttgccagataacaag

SEQ ID NO: 977513 - DNA, 25 bp, Mus musculus
ttttactcctggctgtcatgttgtc

SEQ ID NO: 977514 - DNA, 25 bp, Mus musculus
ttttactcctgggtgtcatgttgtc

SEQ ID NO: 977515 - DNA, 25 bp, Mus musculus
ttttactcgatgctcatatcttaga

SEQ ID NO: 977516 - DNA, 25 bp, Mus musculus
ttttactcgatggtcatatcttaga

SEQ ID NO: 977517 - DNA, 25 bp, Mus musculus
ttttactctatgatttggcactggg

SEQ ID NO: 977518 - DNA, 25 bp, Mus musculus
ttttactctatgttttggcactggg

SEQ ID NO: 977519 - DNA, 25 bp, Mus musculus
ttttactctctcattgctgtcaggg

SEQ ID NO: 977520 - DNA, 25 bp, Mus musculus
ttttactctctctttgctgtcaggg

SEQ ID NO: 977521 - DNA, 25 bp, Mus musculus
ttttactcttctatcattgcttgct

SEQ ID NO: 977522 - DNA, 25 bp, Mus musculus
ttttactcttctttcattgcttgct

SEQ ID NO: 977523 - DNA, 25 bp, Mus musculus
ttttactgaaaactggctccccatc

SEQ ID NO: 977524 - DNA, 25 bp, Mus musculus
ttttactgaaaagtggctccccatc

SEQ ID NO: 977525 - DNA, 25 bp, Mus musculus
ttttactgagcgaatttgaattttt

SEQ ID NO: 977526 - DNA, 25 bp, Mus musculus
ttttactgagcgtatttgaattttt

SEQ ID NO: 977527 - DNA, 25 bp, Mus musculus
ttttactgaggaagctctgtctccc

SEQ ID NO: 977528 - DNA, 25 bp, Mus musculus
ttttactgaggatgctctgtctccc

SEQ ID NO: 977529 - DNA, 25 bp, Mus musculus
ttttactgcattctttggaagaggt

SEQ ID NO: 977530 - DNA, 25 bp, Mus musculus
ttttactgcattgtttggaagaggt

SEQ ID NO: 977531 - DNA, 25 bp, Mus musculus
ttttactgccctccctttgttcgtg

SEQ ID NO: 977532 - DNA, 25 bp, Mus musculus
ttttactgccctgcctttgttcgtg

SEQ ID NO: 977533 - DNA, 25 bp, Mus musculus
ttttactgccgacatgttgctgaaa

SEQ ID NO: 977534 - DNA, 25 bp, Mus musculus
ttttactgccgagatgttgctgaaa

SEQ ID NO: 977535 - DNA, 25 bp, Mus musculus
ttttactgtcggaagaggttgcatg

SEQ ID NO: 977536 - DNA, 25 bp, Mus musculus
ttttactgtcggtagaggttgcatg

SEQ ID NO: 977537 - DNA, 25 bp, Mus musculus
ttttactgtgccatgcttagagcca

SEQ ID NO: 977538 - DNA, 25 bp, Mus musculus
ttttactgtgccttgcttagagcca

SEQ ID NO: 977539 - DNA, 25 bp, Mus musculus
ttttactgtgctatccttacgatga

SEQ ID NO: 977540 - DNA, 25 bp, Mus musculus
ttttactgtgctttccttacgatga

SEQ ID NO: 977541 - DNA, 25 bp, Mus musculus
ttttactgtggaatatctgttggcc

SEQ ID NO: 977542 - DNA, 25 bp, Mus musculus
ttttactgtggattatctgttggcc

SEQ ID NO: 977543 - DNA, 25 bp, Mus musculus
ttttactgtgttagggcatgtcaat

SEQ ID NO: 977544 - DNA, 25 bp, Mus musculus
ttttactgtgtttgggcatgtcaat

SEQ ID NO: 977545 - DNA, 25 bp, Mus musculus
ttttactgttacattcctgttcctc

SEQ ID NO: 977546 - DNA, 25 bp, Mus musculus
ttttactgttactttcctgttcctc

SEQ ID NO: 977547 - DNA, 25 bp, Mus musculus
ttttactgttctccacgcaattata

SEQ ID NO: 977548 - DNA, 25 bp, Mus musculus
ttttactgttctgcacgcaattata

SEQ ID NO: 977549 - DNA, 25 bp, Mus musculus
ttttacttaatgacacctggcagat

SEQ ID NO: 977550 - DNA, 25 bp, Mus musculus
ttttacttaatgtcacctggcagat

SEQ ID NO: 977551 - DNA, 25 bp, Mus musculus
ttttacttactgacagctgttcccc

SEQ ID NO: 977552 - DNA, 25 bp, Mus musculus
ttttacttactgtcagctgttcccc

SEQ ID NO: 977553 - DNA, 25 bp, Mus musculus
ttttacttcaacaagcccacaggct

SEQ ID NO: 977554 - DNA, 25 bp, Mus musculus
ttttacttcaactagcccacaggct

SEQ ID NO: 977555 - DNA, 25 bp, Mus musculus
ttttacttcccacggtgcttttgtg

SEQ ID NO: 977556 - DNA, 25 bp, Mus musculus
ttttacttcccagggtgcttttgtg

SEQ ID NO: 977557 - DNA, 25 bp, Mus musculus
ttttacttccctcctgtttatttgc

SEQ ID NO: 977558 - DNA, 25 bp, Mus musculus
ttttacttccctgctgtttatttgc

SEQ ID NO: 977559 - DNA, 25 bp, Mus musculus
ttttacttccggaatattcaagcaa

SEQ ID NO: 977560 - DNA, 25 bp, Mus musculus
ttttacttccggtatattcaagcaa

SEQ ID NO: 977561 - DNA, 25 bp, Mus musculus
ttttacttctagcatgtggccccag

SEQ ID NO: 977562 - DNA, 25 bp, Mus musculus
ttttacttctaggatgtggccccag

SEQ ID NO: 977563 - DNA, 25 bp, Mus musculus
ttttacttctgtataggcagtctca

SEQ ID NO: 977564 - DNA, 25 bp, Mus musculus
ttttacttctgtttaggcagtctca

SEQ ID NO: 977565 - DNA, 25 bp, Mus musculus
ttttactttaacatcactccctgtg

SEQ ID NO: 977566 - DNA, 25 bp, Mus musculus
ttttactttaacttcactccctgtg

SEQ ID NO: 977567 - DNA, 25 bp, Mus musculus
ttttactttcagctttggctttgat

SEQ ID NO: 977568 - DNA, 25 bp, Mus musculus
ttttactttcaggtttggctttgat

SEQ ID NO: 977569 - DNA, 25 bp, Mus musculus
ttttactttggcactaattctgaat

SEQ ID NO: 977570 - DNA, 25 bp, Mus musculus
ttttactttggctctaattctgaat

SEQ ID NO: 977571 - DNA, 25 bp, Mus musculus
ttttactttttcacacctgcctagt

SEQ ID NO: 977572 - DNA, 25 bp, Mus musculus
ttttactttttctcacctgcctagt

SEQ ID NO: 977573 - DNA, 25 bp, Mus musculus
ttttagaacctgcttgtgcacacct

SEQ ID NO: 977574 - DNA, 25 bp, Mus musculus
ttttagaacctggttgtgcacacct

SEQ ID NO: 977575 - DNA, 25 bp, Mus musculus
ttttagaattgcacttggtgcctcc

SEQ ID NO: 977576 - DNA, 25 bp, Mus musculus
ttttagaattgctcttggtgcctcc

SEQ ID NO: 977577 - DNA, 25 bp, Mus musculus
ttttagacagtccttaagtttccag

SEQ ID NO: 977578 - DNA, 25 bp, Mus musculus
ttttagacagtcgttaagtttccag

SEQ ID NO: 977579 - DNA, 25 bp, Mus musculus
ttttagaccattaaaatgtttgtgc

SEQ ID NO: 977580 - DNA, 25 bp, Mus musculus
ttttagaccatttaaatgtttgtgc

SEQ ID NO: 977581 - DNA, 25 bp, Mus musculus
ttttagacctacctgccttgagcta

SEQ ID NO: 977582 - DNA, 25 bp, Mus musculus
ttttagacctacgtgccttgagcta

SEQ ID NO: 977583 - DNA, 25 bp, Mus musculus
ttttagacgcaaagcccatggagaa

SEQ ID NO: 977584 - DNA, 25 bp, Mus musculus
ttttagacgcaatgcccatggagaa

SEQ ID NO: 977585 - DNA, 25 bp, Mus musculus
ttttagactttacaaaacacatgcc

SEQ ID NO: 977586 - DNA, 25 bp, Mus musculus
ttttagactttagaaaacacatgcc

SEQ ID NO: 977587 - DNA, 25 bp, Mus musculus
ttttagagctgtagtgggtgtaagt

SEQ ID NO: 977588 - DNA, 25 bp, Mus musculus
ttttagagctgttgtgggtgtaagt

SEQ ID NO: 977589 - DNA, 25 bp, Mus musculus
ttttagagggaaaagtgctcatctt

SEQ ID NO: 977590 - DNA, 25 bp, Mus musculus
ttttagagggaatagtgctcatctt

SEQ ID NO: 977591 - DNA, 25 bp, Mus musculus
ttttagaggtagagcccaggtccat

SEQ ID NO: 977592 - DNA, 25 bp, Mus musculus
ttttagaggtagtgcccaggtccat

SEQ ID NO: 977593 - DNA, 25 bp, Mus musculus
ttttagagtagccactgtttccctc

SEQ ID NO: 977594 - DNA, 25 bp, Mus musculus
ttttagagtagcgactgtttccctc

SEQ ID NO: 977595 - DNA, 25 bp, Mus musculus
ttttagagttagaggcagcaggatc

SEQ ID NO: 977596 - DNA, 25 bp, Mus musculus
ttttagagttagtggcagcaggatc

SEQ ID NO: 977597 - DNA, 25 bp, Mus musculus
ttttagatcatcatgtcttcttcct

SEQ ID NO: 977598 - DNA, 25 bp, Mus musculus
ttttagatcatcttgtcttcttcct

SEQ ID NO: 977599 - DNA, 25 bp, Mus musculus
ttttagatccctctgttctgaccca

SEQ ID NO: 977600 - DNA, 25 bp, Mus musculus
ttttagatccctgtgttctgaccca

SEQ ID NO: 977601 - DNA, 25 bp, Mus musculus
ttttagatgtctatgcaggcctggt

SEQ ID NO: 977602 - DNA, 25 bp, Mus musculus
ttttagatgtctttgcaggcctggt

SEQ ID NO: 977603 - DNA, 25 bp, Mus musculus
ttttagatttcccatacctatgacg

SEQ ID NO: 977604 - DNA, 25 bp, Mus musculus
ttttagatttccgatacctatgacg

SEQ ID NO: 977605 - DNA, 25 bp, Mus musculus
ttttagcaccaactgggccatggat

SEQ ID NO: 977606 - DNA, 25 bp, Mus musculus
ttttagcaccaagtgggccatggat

SEQ ID NO: 977607 - DNA, 25 bp, Mus musculus
ttttagcagaagacagtattccagc

SEQ ID NO: 977608 - DNA, 25 bp, Mus musculus
ttttagcagaagtcagtattccagc

SEQ ID NO: 977609 - DNA, 25 bp, Mus musculus
ttttagcaggatcggcttcttcagc

SEQ ID NO: 977610 - DNA, 25 bp, Mus musculus
ttttagcaggatgggcttcttcagc

SEQ ID NO: 977611 - DNA, 25 bp, Mus musculus
ttttagcaggttcttttcattagca

SEQ ID NO: 977612 - DNA, 25 bp, Mus musculus
ttttagcaggttgttttcattagca

SEQ ID NO: 977613 - DNA, 25 bp, Mus musculus
ttttagccaaaaagtcaacttcttt

SEQ ID NO: 977614 - DNA, 25 bp, Mus musculus
ttttagccaaaatgtcaacttcttt

SEQ ID NO: 977615 - DNA, 25 bp, Mus musculus
ttttagccagacacacacactgttc

SEQ ID NO: 977616 - DNA, 25 bp, Mus musculus
ttttagccagactcacacactgttc

SEQ ID NO: 977617 - DNA, 25 bp, Mus musculus
ttttagccagctctagtttcaatgc

SEQ ID NO: 977618 - DNA, 25 bp, Mus musculus
ttttagccagctgtagtttcaatgc

SEQ ID NO: 977619 - DNA, 25 bp, Mus musculus
ttttagcccgagactgccgcttcag

SEQ ID NO: 977620 - DNA, 25 bp, Mus musculus
ttttagcccgagtctgccgcttcag

SEQ ID NO: 977621 - DNA, 25 bp, Mus musculus
ttttagctaaacaaagacctttcag

SEQ ID NO: 977622 - DNA, 25 bp, Mus musculus
ttttagctaaactaagacctttcag

SEQ ID NO: 977623 - DNA, 25 bp, Mus musculus
ttttagctacccacaccaacatcat

SEQ ID NO: 977624 - DNA, 25 bp, Mus musculus
ttttagctaccctcaccaacatcat

SEQ ID NO: 977625 - DNA, 25 bp, Mus musculus
ttttagctatatatcacacgtctga

SEQ ID NO: 977626 - DNA, 25 bp, Mus musculus
ttttagctatatttcacacgtctga

SEQ ID NO: 977627 - DNA, 25 bp, Mus musculus
ttttagctcattaaagacactactg

SEQ ID NO: 977628 - DNA, 25 bp, Mus musculus
ttttagctcatttaagacactactg

SEQ ID NO: 977629 - DNA, 25 bp, Mus musculus
ttttagctctgaactcactcttcag

SEQ ID NO: 977630 - DNA, 25 bp, Mus musculus
ttttagctctgatctcactcttcag

SEQ ID NO: 977631 - DNA, 25 bp, Mus musculus
ttttagctgaagacctgcgcctgca

SEQ ID NO: 977632 - DNA, 25 bp, Mus musculus
ttttagctgaagtcctgcgcctgca

SEQ ID NO: 977633 - DNA, 25 bp, Mus musculus
ttttagctgcccacataaatatata

SEQ ID NO: 977634 - DNA, 25 bp, Mus musculus
ttttagctgccctcataaatatata

SEQ ID NO: 977635 - DNA, 25 bp, Mus musculus
ttttagctgctaacacttgcctgtc

SEQ ID NO: 977636 - DNA, 25 bp, Mus musculus
ttttagctgctatcacttgcctgtc

SEQ ID NO: 977637 - DNA, 25 bp, Mus musculus
ttttagctgctcactctggagaaag

SEQ ID NO: 977638 - DNA, 25 bp, Mus musculus
ttttagctgctctctctggagaaag

SEQ ID NO: 977639 - DNA, 25 bp, Mus musculus
ttttaggaaacaagcaagactgaat

SEQ ID NO: 977640 - DNA, 25 bp, Mus musculus
ttttaggaaacatgcaagactgaat

SEQ ID NO: 977641 - DNA, 25 bp, Mus musculus
ttttaggatttcatcatcaccgtgt

SEQ ID NO: 977642 - DNA, 25 bp, Mus musculus
ttttaggatttcttcatcaccgtgt

SEQ ID NO: 977643 - DNA, 25 bp, Mus musculus
ttttaggatttgaccctcactgggt

SEQ ID NO: 977644 - DNA, 25 bp, Mus musculus
ttttaggatttgtccctcactgggt

SEQ ID NO: 977645 - DNA, 25 bp, Mus musculus
ttttaggcagtcacccaggccacgt

SEQ ID NO: 977646 - DNA, 25 bp, Mus musculus
ttttaggcagtctcccaggccacgt

SEQ ID NO: 977647 - DNA, 25 bp, Mus musculus
ttttaggctgggactgatggcacct

SEQ ID NO: 977648 - DNA, 25 bp, Mus musculus
ttttaggctgggtctgatggcacct

SEQ ID NO: 977649 - DNA, 25 bp, Mus musculus
ttttaggtcccaataggcggaactg

SEQ ID NO: 977650 - DNA, 25 bp, Mus musculus
ttttaggtcccattaggcggaactg

SEQ ID NO: 977651 - DNA, 25 bp, Mus musculus
ttttaggtgatcacaggagtgggca

SEQ ID NO: 977652 - DNA, 25 bp, Mus musculus
ttttaggtgatctcaggagtgggca

SEQ ID NO: 977653 - DNA, 25 bp, Mus musculus
ttttaggtgcgaagctgtcaggagt

SEQ ID NO: 977654 - DNA, 25 bp, Mus musculus
ttttaggtgcgatgctgtcaggagt

SEQ ID NO: 977655 - DNA, 25 bp, Mus musculus
ttttaggtgtaaattgccaaggtct

SEQ ID NO: 977656 - DNA, 25 bp, Mus musculus
ttttaggtgtaatttgccaaggtct

SEQ ID NO: 977657 - DNA, 25 bp, Mus musculus
ttttaggtgtgtaaagcccagcttg

SEQ ID NO: 977658 - DNA, 25 bp, Mus musculus
ttttaggtgtgttaagcccagcttg

SEQ ID NO: 977659 - DNA, 25 bp, Mus musculus
ttttaggttgtgctctgttctttcc

SEQ ID NO: 977660 - DNA, 25 bp, Mus musculus
ttttaggttgtggtctgttctttcc

SEQ ID NO: 977661 - DNA, 25 bp, Mus musculus
ttttagtaagctctaggccactggg

SEQ ID NO: 977662 - DNA, 25 bp, Mus musculus
ttttagtaagctgtaggccactggg

SEQ ID NO: 977663 - DNA, 25 bp, Mus musculus
ttttagtactaacctgccttggcag

SEQ ID NO: 977664 - DNA, 25 bp, Mus musculus
ttttagtactaagctgccttggcag

SEQ ID NO: 977665 - DNA, 25 bp, Mus musculus
ttttagtacttcctgattacaccct

SEQ ID NO: 977666 - DNA, 25 bp, Mus musculus
ttttagtacttcgtgattacaccct

SEQ ID NO: 977667 - DNA, 25 bp, Mus musculus
ttttagtatcaaagactgtgacccc

SEQ ID NO: 977668 - DNA, 25 bp, Mus musculus
ttttagtatcaatgactgtgacccc

SEQ ID NO: 977669 - DNA, 25 bp, Mus musculus
ttttagtatgcgctgtactgccata

SEQ ID NO: 977670 - DNA, 25 bp, Mus musculus
ttttagtatgcggtgtactgccata

SEQ ID NO: 977671 - DNA, 25 bp, Mus musculus
ttttagtccttacgtgagtcaccca

SEQ ID NO: 977672 - DNA, 25 bp, Mus musculus
ttttagtccttaggtgagtcaccca

SEQ ID NO: 977673 - DNA, 25 bp, Mus musculus
ttttagtctataagtggcacaccac

SEQ ID NO: 977674 - DNA, 25 bp, Mus musculus
ttttagtctatatgtggcacaccac

SEQ ID NO: 977675 - DNA, 25 bp, Mus musculus
ttttagtctcagactggtgacccca

SEQ ID NO: 977676 - DNA, 25 bp, Mus musculus
ttttagtctcagtctggtgacccca

SEQ ID NO: 977677 - DNA, 25 bp, Mus musculus
ttttagtcttgcctatcttagggag

SEQ ID NO: 977678 - DNA, 25 bp, Mus musculus
ttttagtcttgcgtatcttagggag

SEQ ID NO: 977679 - DNA, 25 bp, Mus musculus
ttttagtgacctagggcacgtcctt

SEQ ID NO: 977680 - DNA, 25 bp, Mus musculus
ttttagtgaccttgggcacgtcctt

SEQ ID NO: 977681 - DNA, 25 bp, Mus musculus
ttttagtgacttcaccttgtgacct

SEQ ID NO: 977682 - DNA, 25 bp, Mus musculus
ttttagtgacttgaccttgtgacct

SEQ ID NO: 977683 - DNA, 25 bp, Mus musculus
ttttagtggctgagggaggcacccc

SEQ ID NO: 977684 - DNA, 25 bp, Mus musculus
ttttagtggctgtgggaggcacccc

SEQ ID NO: 977685 - DNA, 25 bp, Mus musculus
ttttagtgtggcagcattgatggag

SEQ ID NO: 977686 - DNA, 25 bp, Mus musculus
ttttagtgtggctgcattgatggag

SEQ ID NO: 977687 - DNA, 25 bp, Mus musculus
ttttagtgttcacttatcttttcct

SEQ ID NO: 977688 - DNA, 25 bp, Mus musculus
ttttagtgttcagttatcttttcct

SEQ ID NO: 977689 - DNA, 25 bp, Mus musculus
ttttagttcagtaacaagattcaac

SEQ ID NO: 977690 - DNA, 25 bp, Mus musculus
ttttagttcagttacaagattcaac

SEQ ID NO: 977691 - DNA, 25 bp, Mus musculus
ttttagttcgctaccttaattgtat

SEQ ID NO: 977692 - DNA, 25 bp, Mus musculus
ttttagttcgcttccttaattgtat

SEQ ID NO: 977693 - DNA, 25 bp, Mus musculus
ttttagttctgcaaattctgcctgg

SEQ ID NO: 977694 - DNA, 25 bp, Mus musculus
ttttagttctgctaattctgcctgg

SEQ ID NO: 977695 - DNA, 25 bp, Mus musculus
ttttagttcttacctttgccctttg

SEQ ID NO: 977696 - DNA, 25 bp, Mus musculus
ttttagttcttagctttgccctttg

SEQ ID NO: 977697 - DNA, 25 bp, Mus musculus
ttttagttcttgataattctgcctc

SEQ ID NO: 977698 - DNA, 25 bp, Mus musculus
ttttagttcttgttaattctgcctc

SEQ ID NO: 977699 - DNA, 25 bp, Mus musculus
ttttagttgcatatccctggagttc

SEQ ID NO: 977700 - DNA, 25 bp, Mus musculus
ttttagttgcatttccctggagttc

SEQ ID NO: 977701 - DNA, 25 bp, Mus musculus
ttttagttgctacaggaccgggtca

SEQ ID NO: 977702 - DNA, 25 bp, Mus musculus
ttttagttgctagaggaccgggtca

SEQ ID NO: 977703 - DNA, 25 bp, Mus musculus
ttttagttgggcaggaactcactat

SEQ ID NO: 977704 - DNA, 25 bp, Mus musculus
ttttagttgggctggaactcactat

SEQ ID NO: 977705 - DNA, 25 bp, Mus musculus
ttttagttggtgactcatgtggtct

SEQ ID NO: 977706 - DNA, 25 bp, Mus musculus
ttttagttggtgtctcatgtggtct

SEQ ID NO: 977707 - DNA, 25 bp, Mus musculus
ttttagttgttacgaggaatttgat

SEQ ID NO: 977708 - DNA, 25 bp, Mus musculus
ttttagttgttaggaggaatttgat

SEQ ID NO: 977709 - DNA, 25 bp, Mus musculus
ttttagtttaacacacaggacaata

SEQ ID NO: 977710 - DNA, 25 bp, Mus musculus
ttttagtttaactcacaggacaata

SEQ ID NO: 977711 - DNA, 25 bp, Mus musculus
ttttagtttcatagattggcaggac

SEQ ID NO: 977712 - DNA, 25 bp, Mus musculus
ttttagtttcattgattggcaggac

SEQ ID NO: 977713 - DNA, 25 bp, Mus musculus
ttttagtttctaactcgtgtcccca

SEQ ID NO: 977714 - DNA, 25 bp, Mus musculus
ttttagtttctatctcgtgtcccca

SEQ ID NO: 977715 - DNA, 25 bp, Mus musculus
ttttagtttggacccttcccacact

SEQ ID NO: 977716 - DNA, 25 bp, Mus musculus
ttttagtttggagccttcccacact

SEQ ID NO: 977717 - DNA, 25 bp, Mus musculus
ttttagttttgccaagctgactgtg

SEQ ID NO: 977718 - DNA, 25 bp, Mus musculus
ttttagttttgcgaagctgactgtg

SEQ ID NO: 977719 - DNA, 25 bp, Mus musculus
ttttataaacaaacctgactctgcc

SEQ ID NO: 977720 - DNA, 25 bp, Mus musculus
ttttataaacaatcctgactctgcc

SEQ ID NO: 977721 - DNA, 25 bp, Mus musculus
ttttataacttgctcagaacatcag

SEQ ID NO: 977722 - DNA, 25 bp, Mus musculus
ttttataacttggtcagaacatcag

SEQ ID NO: 977723 - DNA, 25 bp, Mus musculus
ttttataatgtaccctcactcttcc

SEQ ID NO: 977724 - DNA, 25 bp, Mus musculus
ttttataatgtagcctcactcttcc

SEQ ID NO: 977725 - DNA, 25 bp, Mus musculus
ttttatacagatcttgtcccattgc

SEQ ID NO: 977726 - DNA, 25 bp, Mus musculus
ttttatacagatgttgtcccattgc

SEQ ID NO: 977727 - DNA, 25 bp, Mus musculus
ttttatactaaccatttcttacaga

SEQ ID NO: 977728 - DNA, 25 bp, Mus musculus
ttttatactaacgatttcttacaga

SEQ ID NO: 977729 - DNA, 25 bp, Mus musculus
ttttatactcctacttacccattct

SEQ ID NO: 977730 - DNA, 25 bp, Mus musculus
ttttatactcctctcggtacccacg

SEQ ID NO: 977731 - DNA, 25 bp, Mus musculus
ttttatactcctgtcggtacccacg

SEQ ID NO: 977732 - DNA, 25 bp, Mus musculus
ttttatactccttcttacccattct

SEQ ID NO: 977733 - DNA, 25 bp, Mus musculus
ttttatactcttcattgtactaaga

SEQ ID NO: 977734 - DNA, 25 bp, Mus musculus
ttttatactcttgattgtactaaga

SEQ ID NO: 977735 - DNA, 25 bp, Mus musculus
ttttatacttctcctatacactaaa

SEQ ID NO: 977736 - DNA, 25 bp, Mus musculus
ttttatacttctgctatacactaaa

SEQ ID NO: 977737 - DNA, 25 bp, Mus musculus
ttttatacttggacctgtgtcctag

SEQ ID NO: 977738 - DNA, 25 bp, Mus musculus
ttttatacttggtcctgtgtcctag

SEQ ID NO: 977739 - DNA, 25 bp, Mus musculus
ttttatagaacacaggcaccctcat

SEQ ID NO: 977740 - DNA, 25 bp, Mus musculus
ttttatagaacagaggcaccctcat

SEQ ID NO: 977741 - DNA, 25 bp, Mus musculus
ttttatagacaccagcggccacaaa

SEQ ID NO: 977742 - DNA, 25 bp, Mus musculus
ttttatagacacgagcggccacaaa

SEQ ID NO: 977743 - DNA, 25 bp, Mus musculus
ttttatagggatctatcaccatgcc

SEQ ID NO: 977744 - DNA, 25 bp, Mus musculus
ttttatagggatgtatcaccatgcc

SEQ ID NO: 977745 - DNA, 25 bp, Mus musculus
ttttatagtaagcttcctccacctg

SEQ ID NO: 977746 - DNA, 25 bp, Mus musculus
ttttatagtaaggttcctccacctg

SEQ ID NO: 977747 - DNA, 25 bp, Mus musculus
ttttatagtcccagctgggatccac

SEQ ID NO: 977748 - DNA, 25 bp, Mus musculus
ttttatagtccctgctgggatccac

SEQ ID NO: 977749 - DNA, 25 bp, Mus musculus
ttttatagttaaatgccctcacagc

SEQ ID NO: 977750 - DNA, 25 bp, Mus musculus
ttttatagttaattgccctcacagc

SEQ ID NO: 977751 - DNA, 25 bp, Mus musculus
ttttatatagcactctctctgtgtc

SEQ ID NO: 977752 - DNA, 25 bp, Mus musculus
ttttatatagcagtctctctgtgtc

SEQ ID NO: 977753 - DNA, 25 bp, Mus musculus
ttttatatagttcggacatcagctg

SEQ ID NO: 977754 - DNA, 25 bp, Mus musculus
ttttatatagttgggacatcagctg

SEQ ID NO: 977755 - DNA, 25 bp, Mus musculus
ttttatatccaaatccttttctggg

SEQ ID NO: 977756 - DNA, 25 bp, Mus musculus
ttttatatccaattccttttctggg

SEQ ID NO: 977757 - DNA, 25 bp, Mus musculus
ttttatatccccaggactcttatgg

SEQ ID NO: 977758 - DNA, 25 bp, Mus musculus
ttttatatcccctggactcttatgg

SEQ ID NO: 977759 - DNA, 25 bp, Mus musculus
ttttatatcgccactgatgtctggt

SEQ ID NO: 977760 - DNA, 25 bp, Mus musculus
ttttatatcgcctctgatgtctggt

SEQ ID NO: 977761 - DNA, 25 bp, Mus musculus
ttttatatcttcatgcttactgtgc

SEQ ID NO: 977762 - DNA, 25 bp, Mus musculus
ttttatatcttcttgcttactgtgc

SEQ ID NO: 977763 - DNA, 25 bp, Mus musculus
ttttatatgccaactccaagctggg

SEQ ID NO: 977764 - DNA, 25 bp, Mus musculus
ttttatatgccatctccaagctggg

SEQ ID NO: 977765 - DNA, 25 bp, Mus musculus
ttttatatgtgtccccacatgcggg

SEQ ID NO: 977766 - DNA, 25 bp, Mus musculus
ttttatatgtgtgcccacatgcggg

SEQ ID NO: 977767 - DNA, 25 bp, Mus musculus
ttttatattcccattatctcctcta

SEQ ID NO: 977768 - DNA, 25 bp, Mus musculus
ttttatattccctttatctcctcta

SEQ ID NO: 977769 - DNA, 25 bp, Mus musculus
ttttatattgataacttgctcacag

SEQ ID NO: 977770 - DNA, 25 bp, Mus musculus
ttttatattgattacttgctcacag

SEQ ID NO: 977771 - DNA, 25 bp, Mus musculus
ttttatattgttagcatcccattgc

SEQ ID NO: 977772 - DNA, 25 bp, Mus musculus
ttttatattgtttgcatcccattgc

SEQ ID NO: 977773 - DNA, 25 bp, Mus musculus
ttttatcaacaaacccgctagggtg

SEQ ID NO: 977774 - DNA, 25 bp, Mus musculus
ttttatcaacaatcccgctagggtg

SEQ ID NO: 977775 - DNA, 25 bp, Mus musculus
ttttatcaccaactcttctccagag

SEQ ID NO: 977776 - DNA, 25 bp, Mus musculus
ttttatcaccaagtcttctccagag

SEQ ID NO: 977777 - DNA, 25 bp, Mus musculus
ttttatcacccaacattttagcacg

SEQ ID NO: 977778 - DNA, 25 bp, Mus musculus
ttttatcacccacattcttctgaag

SEQ ID NO: 977779 - DNA, 25 bp, Mus musculus
ttttatcacccagattcttctgaag

SEQ ID NO: 977780 - DNA, 25 bp, Mus musculus
ttttatcacccatcattttagcacg

SEQ ID NO: 977781 - DNA, 25 bp, Mus musculus
ttttatcactgaacaatatctttgt

SEQ ID NO: 977782 - DNA, 25 bp, Mus musculus
ttttatcactgatcaatatctttgt

SEQ ID NO: 977783 - DNA, 25 bp, Mus musculus
ttttatcatactcactttccatcct

SEQ ID NO: 977784 - DNA, 25 bp, Mus musculus
ttttatcatactgactttccatcct

SEQ ID NO: 977785 - DNA, 25 bp, Mus musculus
ttttatcattgaagagttatctgct

SEQ ID NO: 977786 - DNA, 25 bp, Mus musculus
ttttatcattgatgagttatctgct

SEQ ID NO: 977787 - DNA, 25 bp, Mus musculus
ttttatccactcatatgactctctc

SEQ ID NO: 977788 - DNA, 25 bp, Mus musculus
ttttatccactcttatgactctctc

SEQ ID NO: 977789 - DNA, 25 bp, Mus musculus
ttttatccactgagacatcttgctg

SEQ ID NO: 977790 - DNA, 25 bp, Mus musculus
ttttatccactgtgacatcttgctg

SEQ ID NO: 977791 - DNA, 25 bp, Mus musculus
ttttatccagccatggatcacagcc

SEQ ID NO: 977792 - DNA, 25 bp, Mus musculus
ttttatccagccttggatcacagcc

SEQ ID NO: 977793 - DNA, 25 bp, Mus musculus
ttttatccatagcacatcccatatc

SEQ ID NO: 977794 - DNA, 25 bp, Mus musculus
ttttatccataggacatcccatatc

SEQ ID NO: 977795 - DNA, 25 bp, Mus musculus
ttttatccatccataacaacatgat

SEQ ID NO: 977796 - DNA, 25 bp, Mus musculus
ttttatccatccttaacaacatgat

SEQ ID NO: 977797 - DNA, 25 bp, Mus musculus
ttttatcccacacaaatgaacgtag

SEQ ID NO: 977798 - DNA, 25 bp, Mus musculus
ttttatcccacagaaatgaacgtag

SEQ ID NO: 977799 - DNA, 25 bp, Mus musculus
ttttatcccatcactttgttaaaag

SEQ ID NO: 977800 - DNA, 25 bp, Mus musculus
ttttatcccatctctttgttaaaag

SEQ ID NO: 977801 - DNA, 25 bp, Mus musculus
ttttatccccacagaggtgacagga

SEQ ID NO: 977802 - DNA, 25 bp, Mus musculus
ttttatccccactgaggtgacagga

SEQ ID NO: 977803 - DNA, 25 bp, Mus musculus
ttttatccccagatgttactcatga

SEQ ID NO: 977804 - DNA, 25 bp, Mus musculus
ttttatccccagttgttactcatga

SEQ ID NO: 977805 - DNA, 25 bp, Mus musculus
ttttatcccggcacttggagacaga

SEQ ID NO: 977806 - DNA, 25 bp, Mus musculus
ttttatcccggctcttggagacaga

SEQ ID NO: 977807 - DNA, 25 bp, Mus musculus
ttttatccgacaagcagactcttca

SEQ ID NO: 977808 - DNA, 25 bp, Mus musculus
ttttatccgacatgcagactcttca

SEQ ID NO: 977809 - DNA, 25 bp, Mus musculus
ttttatcctatgacgaaagaacggg

SEQ ID NO: 977810 - DNA, 25 bp, Mus musculus
ttttatcctatgtcgaaagaacggg

SEQ ID NO: 977811 - DNA, 25 bp, Mus musculus
ttttatcctcatctgcaacaattct

SEQ ID NO: 977812 - DNA, 25 bp, Mus musculus
ttttatcctcatgtgcaacaattct

SEQ ID NO: 977813 - DNA, 25 bp, Mus musculus
ttttatcctccacaagcccttacaa

SEQ ID NO: 977814 - DNA, 25 bp, Mus musculus
ttttatcctccagaagcccttacaa

SEQ ID NO: 977815 - DNA, 25 bp, Mus musculus
ttttatccttatatccaatgccctg

SEQ ID NO: 977816 - DNA, 25 bp, Mus musculus
ttttatccttatttccaatgccctg

SEQ ID NO: 977817 - DNA, 25 bp, Mus musculus
ttttatcgtcccaggccctatctaa

SEQ ID NO: 977818 - DNA, 25 bp, Mus musculus
ttttatcgtccctggccctatctaa

SEQ ID NO: 977819 - DNA, 25 bp, Mus musculus
ttttatctagggaggaatgtatctt

SEQ ID NO: 977820 - DNA, 25 bp, Mus musculus
ttttatctagggtggaatgtatctt

SEQ ID NO: 977821 - DNA, 25 bp, Mus musculus
ttttatctatccattaccctcctgg

SEQ ID NO: 977822 - DNA, 25 bp, Mus musculus
ttttatctatcctttaccctcctgg

SEQ ID NO: 977823 - DNA, 25 bp, Mus musculus
ttttatctcatcacccaagtatggg

SEQ ID NO: 977824 - DNA, 25 bp, Mus musculus
ttttatctcatctcccaagtatggg

SEQ ID NO: 977825 - DNA, 25 bp, Mus musculus
ttttatctctcacacctacaaggtg

SEQ ID NO: 977826 - DNA, 25 bp, Mus musculus
ttttatctctcagacctacaaggtg

SEQ ID NO: 977827 - DNA, 25 bp, Mus musculus
ttttatctgcagcacctgtggtgaa

SEQ ID NO: 977828 - DNA, 25 bp, Mus musculus
ttttatctgcaggacctgtggtgaa

SEQ ID NO: 977829 - DNA, 25 bp, Mus musculus
ttttatctggttaggtaactattga

SEQ ID NO: 977830 - DNA, 25 bp, Mus musculus
ttttatctggtttggtaactattga

SEQ ID NO: 977831 - DNA, 25 bp, Mus musculus
ttttatcttcatcttgtgtctgctc

SEQ ID NO: 977832 - DNA, 25 bp, Mus musculus
ttttatcttcatgttgtgtctgctc

SEQ ID NO: 977833 - DNA, 25 bp, Mus musculus
ttttatcttcctattatctctgctc

SEQ ID NO: 977834 - DNA, 25 bp, Mus musculus
ttttatcttccttttatctctgctc

SEQ ID NO: 977835 - DNA, 25 bp, Mus musculus
ttttatcttgttagcctccctgtaa

SEQ ID NO: 977836 - DNA, 25 bp, Mus musculus
ttttatcttgtttgcctccctgtaa

SEQ ID NO: 977837 - DNA, 25 bp, Mus musculus
ttttatctttgaaggcccagggcct

SEQ ID NO: 977838 - DNA, 25 bp, Mus musculus
ttttatctttgatggcccagggcct

SEQ ID NO: 977839 - DNA, 25 bp, Mus musculus
ttttatgaaacgcaccactatggat

SEQ ID NO: 977840 - DNA, 25 bp, Mus musculus
ttttatgaaacggaccactatggat

SEQ ID NO: 977841 - DNA, 25 bp, Mus musculus
ttttatgaaagcctgtaagtggtcc

SEQ ID NO: 977842 - DNA, 25 bp, Mus musculus
ttttatgaaagcgtgtaagtggtcc

SEQ ID NO: 977843 - DNA, 25 bp, Mus musculus
ttttatgaaccccaggcatactgct

SEQ ID NO: 977844 - DNA, 25 bp, Mus musculus
ttttatgaacccgaggcatactgct

SEQ ID NO: 977845 - DNA, 25 bp, Mus musculus
ttttatgaagacaagggttttgcct

SEQ ID NO: 977846 - DNA, 25 bp, Mus musculus
ttttatgaagactagggttttgcct

SEQ ID NO: 977847 - DNA, 25 bp, Mus musculus
ttttatgaaggaaccatctctgtgt

SEQ ID NO: 977848 - DNA, 25 bp, Mus musculus
ttttatgaaggatccatctctgtgt

SEQ ID NO: 977849 - DNA, 25 bp, Mus musculus
ttttatgaagggattgacaaccaga

SEQ ID NO: 977850 - DNA, 25 bp, Mus musculus
ttttatgaagggtttgacaaccaga

SEQ ID NO: 977851 - DNA, 25 bp, Mus musculus
ttttatgaatcaaacgacactgcag

SEQ ID NO: 977852 - DNA, 25 bp, Mus musculus
ttttatgaatcatacgacactgcag

SEQ ID NO: 977853 - DNA, 25 bp, Mus musculus
ttttatgaatttaatgccccttgtt

SEQ ID NO: 977854 - DNA, 25 bp, Mus musculus
ttttatgaatttatcccgaggtgac

SEQ ID NO: 977855 - DNA, 25 bp, Mus musculus
ttttatgaattttatgccccttgtt

SEQ ID NO: 977856 - DNA, 25 bp, Mus musculus
ttttatgaatttttcccgaggtgac

SEQ ID NO: 977857 - DNA, 25 bp, Mus musculus
ttttatgagtctcttgcactgcctg

SEQ ID NO: 977858 - DNA, 25 bp, Mus musculus
ttttatgagtctgttgcactgcctg

SEQ ID NO: 977859 - DNA, 25 bp, Mus musculus
ttttatgatcccaccctcgtattct

SEQ ID NO: 977860 - DNA, 25 bp, Mus musculus
ttttatgatccctccctcgtattct

SEQ ID NO: 977861 - DNA, 25 bp, Mus musculus
ttttatgatggcaaaggtaacccta

SEQ ID NO: 977862 - DNA, 25 bp, Mus musculus
ttttatgatggctaaggtaacccta

SEQ ID NO: 977863 - DNA, 25 bp, Mus musculus
ttttatgcactaattgcctcaggag

SEQ ID NO: 977864 - DNA, 25 bp, Mus musculus
ttttatgcactatttgcctcaggag

SEQ ID NO: 977865 - DNA, 25 bp, Mus musculus
ttttatgcagtcacaacccgtatct

SEQ ID NO: 977866 - DNA, 25 bp, Mus musculus
ttttatgcagtctcaacccgtatct

SEQ ID NO: 977867 - DNA, 25 bp, Mus musculus
ttttatgcagtgcaccccatgggaa

SEQ ID NO: 977868 - DNA, 25 bp, Mus musculus
ttttatgcagtggaccccatgggaa

SEQ ID NO: 977869 - DNA, 25 bp, Mus musculus
ttttatgcatgaacaaggacagcct

SEQ ID NO: 977870 - DNA, 25 bp, Mus musculus
ttttatgcatgatcaaggacagcct

SEQ ID NO: 977871 - DNA, 25 bp, Mus musculus
ttttatgccaccaatcaccaaaaat

SEQ ID NO: 977872 - DNA, 25 bp, Mus musculus
ttttatgccacctatcaccaaaaat

SEQ ID NO: 977873 - DNA, 25 bp, Mus musculus
ttttatgccataattcctaagaagt

SEQ ID NO: 977874 - DNA, 25 bp, Mus musculus
ttttatgccatatttcctaagaagt

SEQ ID NO: 977875 - DNA, 25 bp, Mus musculus
ttttatgccatcagaaacagttctt

SEQ ID NO: 977876 - DNA, 25 bp, Mus musculus
ttttatgccatctgaaacagttctt

SEQ ID NO: 977877 - DNA, 25 bp, Mus musculus
ttttatgccgccctggatcaaatct

SEQ ID NO: 977878 - DNA, 25 bp, Mus musculus
ttttatgccgccgtggatcaaatct

SEQ ID NO: 977879 - DNA, 25 bp, Mus musculus
ttttatgctccgacaagtgctgtgg

SEQ ID NO: 977880 - DNA, 25 bp, Mus musculus
ttttatgctccgtcaagtgctgtgg

SEQ ID NO: 977881 - DNA, 25 bp, Mus musculus
ttttatgctgcaaccagtttctgct

SEQ ID NO: 977882 - DNA, 25 bp, Mus musculus
ttttatgctgcatccagtttctgct

SEQ ID NO: 977883 - DNA, 25 bp, Mus musculus
ttttatggagaacatttcattagaa

SEQ ID NO: 977884 - DNA, 25 bp, Mus musculus
ttttatggagaagatttcattagaa

SEQ ID NO: 977885 - DNA, 25 bp, Mus musculus
ttttatggagcccatgagccaccag

SEQ ID NO: 977886 - DNA, 25 bp, Mus musculus
ttttatggagccgatgagccaccag

SEQ ID NO: 977887 - DNA, 25 bp, Mus musculus
ttttatggagcgctctgaacgaccc

SEQ ID NO: 977888 - DNA, 25 bp, Mus musculus
ttttatggagcggtctgaacgaccc

SEQ ID NO: 977889 - DNA, 25 bp, Mus musculus
ttttatggattcaggctgcatcacc

SEQ ID NO: 977890 - DNA, 25 bp, Mus musculus
ttttatggattctggctgcatcacc

SEQ ID NO: 977891 - DNA, 25 bp, Mus musculus
ttttatggcttcagagtttcatgtc

SEQ ID NO: 977892 - DNA, 25 bp, Mus musculus
ttttatggcttctgagtttcatgtc

SEQ ID NO: 977893 - DNA, 25 bp, Mus musculus
ttttatgggaccagcgcaggacctt

SEQ ID NO: 977894 - DNA, 25 bp, Mus musculus
ttttatgggacctgcgcaggacctt

SEQ ID NO: 977895 - DNA, 25 bp, Mus musculus
ttttatgggctcacaattctgctga

SEQ ID NO: 977896 - DNA, 25 bp, Mus musculus
ttttatgggctctcaattctgctga

SEQ ID NO: 977897 - DNA, 25 bp, Mus musculus
ttttatgggtggcttgtctttgctg

SEQ ID NO: 977898 - DNA, 25 bp, Mus musculus
ttttatgggtgggttgtctttgctg

SEQ ID NO: 977899 - DNA, 25 bp, Mus musculus
ttttatggtgggaaactactctgct

SEQ ID NO: 977900 - DNA, 25 bp, Mus musculus
ttttatggtgggtaactactctgct

SEQ ID NO: 977901 - DNA, 25 bp, Mus musculus
ttttatgtctgtacccaatccttaa

SEQ ID NO: 977902 - DNA, 25 bp, Mus musculus
ttttatgtctgttcccaatccttaa

SEQ ID NO: 977903 - DNA, 25 bp, Mus musculus
ttttatgtgataagtgatgtagcaa

SEQ ID NO: 977904 - DNA, 25 bp, Mus musculus
ttttatgtgatatgtgatgtagcaa

SEQ ID NO: 977905 - DNA, 25 bp, Mus musculus
ttttatgtgtacacgttcatctgtg

SEQ ID NO: 977906 - DNA, 25 bp, Mus musculus
ttttatgtgtactcgttcatctgtg

SEQ ID NO: 977907 - DNA, 25 bp, Mus musculus
ttttatgtgtctcggtgttttggca

SEQ ID NO: 977908 - DNA, 25 bp, Mus musculus
ttttatgtgtctgggtgttttggca

SEQ ID NO: 977909 - DNA, 25 bp, Mus musculus
ttttatgttcttcggctaatggagc

SEQ ID NO: 977910 - DNA, 25 bp, Mus musculus
ttttatgttcttgggctaatggagc

SEQ ID NO: 977911 - DNA, 25 bp, Mus musculus
ttttattaacagacaagtggtcttg

SEQ ID NO: 977912 - DNA, 25 bp, Mus musculus
ttttattaacagtcaagtggtcttg

SEQ ID NO: 977913 - DNA, 25 bp, Mus musculus
ttttattaagatcccgctcaaggtc

SEQ ID NO: 977914 - DNA, 25 bp, Mus musculus
ttttattaagatgccgctcaaggtc

SEQ ID NO: 977915 - DNA, 25 bp, Mus musculus
ttttattaatgtctgacccgaaaat

SEQ ID NO: 977916 - DNA, 25 bp, Mus musculus
ttttattaatgtgtgacccgaaaat

SEQ ID NO: 977917 - DNA, 25 bp, Mus musculus
ttttattacggaatctcgccgctac

SEQ ID NO: 977918 - DNA, 25 bp, Mus musculus
ttttattacggattctcgccgctac

SEQ ID NO: 977919 - DNA, 25 bp, Mus musculus
ttttattagtccctggctttggcca

SEQ ID NO: 977920 - DNA, 25 bp, Mus musculus
ttttattagtccgtggctttggcca

SEQ ID NO: 977921 - DNA, 25 bp, Mus musculus
ttttattatactccctcgacttctc

SEQ ID NO: 977922 - DNA, 25 bp, Mus musculus
ttttattatactgcctcgacttctc

SEQ ID NO: 977923 - DNA, 25 bp, Mus musculus
ttttattatgcaagaatcactgtgt

SEQ ID NO: 977924 - DNA, 25 bp, Mus musculus
ttttattatgcatgaatcactgtgt

SEQ ID NO: 977925 - DNA, 25 bp, Mus musculus
ttttattattatccctgtgatttga

SEQ ID NO: 977926 - DNA, 25 bp, Mus musculus
ttttattattatgcctgtgatttga

SEQ ID NO: 977927 - DNA, 25 bp, Mus musculus
ttttattcaaatctcgcctctcttc

SEQ ID NO: 977928 - DNA, 25 bp, Mus musculus
ttttattcaaatgtcgcctctcttc

SEQ ID NO: 977929 - DNA, 25 bp, Mus musculus
ttttattcacttacagtctttagga

SEQ ID NO: 977930 - DNA, 25 bp, Mus musculus
ttttattcactttcagtctttagga

SEQ ID NO: 977931 - DNA, 25 bp, Mus musculus
ttttattcagttaagtctcagttcc

SEQ ID NO: 977932 - DNA, 25 bp, Mus musculus
ttttattcagtttagtctcagttcc

SEQ ID NO: 977933 - DNA, 25 bp, Mus musculus
ttttattccaacactagcagggttt

SEQ ID NO: 977934 - DNA, 25 bp, Mus musculus
ttttattccaactctagcagggttt

SEQ ID NO: 977935 - DNA, 25 bp, Mus musculus
ttttattccactaacatgaacttta

SEQ ID NO: 977936 - DNA, 25 bp, Mus musculus
ttttattccacttacatgaacttta

SEQ ID NO: 977937 - DNA, 25 bp, Mus musculus
ttttattccagtaagctcagcacgt

SEQ ID NO: 977938 - DNA, 25 bp, Mus musculus
ttttattccagttagctcagcacgt

SEQ ID NO: 977939 - DNA, 25 bp, Mus musculus
ttttattcccaacggctgtggctga

SEQ ID NO: 977940 - DNA, 25 bp, Mus musculus
ttttattcccaagggctgtggctga

SEQ ID NO: 977941 - DNA, 25 bp, Mus musculus
ttttattcccagctggttccgaggg

SEQ ID NO: 977942 - DNA, 25 bp, Mus musculus
ttttattcccaggtggttccgaggg

SEQ ID NO: 977943 - DNA, 25 bp, Mus musculus
ttttattccccaacaaaagcacagg

SEQ ID NO: 977944 - DNA, 25 bp, Mus musculus
ttttattccccatcaaaagcacagg

SEQ ID NO: 977945 - DNA, 25 bp, Mus musculus
ttttattcccgtcatacttctgtct

SEQ ID NO: 977946 - DNA, 25 bp, Mus musculus
ttttattcccgtgatacttctgtct

SEQ ID NO: 977947 - DNA, 25 bp, Mus musculus
ttttattccctccagctttgaagtg

SEQ ID NO: 977948 - DNA, 25 bp, Mus musculus
ttttattccctcgagctttgaagtg

SEQ ID NO: 977949 - DNA, 25 bp, Mus musculus
ttttattcctgtcgggcacacccca

SEQ ID NO: 977950 - DNA, 25 bp, Mus musculus
ttttattcctgtggggcacacccca

SEQ ID NO: 977951 - DNA, 25 bp, Mus musculus
ttttattctaccagacagcttacct

SEQ ID NO: 977952 - DNA, 25 bp, Mus musculus
ttttattctacctgacagcttacct

SEQ ID NO: 977953 - DNA, 25 bp, Mus musculus
ttttattctcagctcaatcggtcac

SEQ ID NO: 977954 - DNA, 25 bp, Mus musculus
ttttattctcaggtcaatcggtcac

SEQ ID NO: 977955 - DNA, 25 bp, Mus musculus
ttttattgcatgatacagtaccagt

SEQ ID NO: 977956 - DNA, 25 bp, Mus musculus
ttttattgcatgttacagtaccagt

SEQ ID NO: 977957 - DNA, 25 bp, Mus musculus
ttttattgccttattctggacttat

SEQ ID NO: 977958 - DNA, 25 bp, Mus musculus
ttttattgcctttttctggacttat

SEQ ID NO: 977959 - DNA, 25 bp, Mus musculus
ttttattgggtaatggtcacactga

SEQ ID NO: 977960 - DNA, 25 bp, Mus musculus
ttttattgggtattggtcacactga

SEQ ID NO: 977961 - DNA, 25 bp, Mus musculus
ttttattggtccactgaaactataa

SEQ ID NO: 977962 - DNA, 25 bp, Mus musculus
ttttattggtcctctgaaactataa

SEQ ID NO: 977963 - DNA, 25 bp, Mus musculus
ttttattgttaaacctgtctagaca

SEQ ID NO: 977964 - DNA, 25 bp, Mus musculus
ttttattgttaatcctgtctagaca

SEQ ID NO: 977965 - DNA, 25 bp, Mus musculus
ttttattgttagagttctggtggct

SEQ ID NO: 977966 - DNA, 25 bp, Mus musculus
ttttattgttagtgttctggtggct

SEQ ID NO: 977967 - DNA, 25 bp, Mus musculus
ttttattgtttcagttctcacaaaa

SEQ ID NO: 977968 - DNA, 25 bp, Mus musculus
ttttattgtttctgttctcacaaaa

SEQ ID NO: 977969 - DNA, 25 bp, Mus musculus
ttttatttaagcacctccgggacag

SEQ ID NO: 977970 - DNA, 25 bp, Mus musculus
ttttatttaagctcctccgggacag

SEQ ID NO: 977971 - DNA, 25 bp, Mus musculus
ttttatttacgcctctaacttctgt

SEQ ID NO: 977972 - DNA, 25 bp, Mus musculus
ttttatttacgcgtctaacttctgt

SEQ ID NO: 977973 - DNA, 25 bp, Mus musculus
ttttatttagcaccttctccattgt

SEQ ID NO: 977974 - DNA, 25 bp, Mus musculus
ttttatttagcagcttctccattgt

SEQ ID NO: 977975 - DNA, 25 bp, Mus musculus
ttttatttagccctcacaccaagca

SEQ ID NO: 977976 - DNA, 25 bp, Mus musculus
ttttatttagccgtcacaccaagca

SEQ ID NO: 977977 - DNA, 25 bp, Mus musculus
ttttatttagggagcctctgtgcca

SEQ ID NO: 977978 - DNA, 25 bp, Mus musculus
ttttatttagggtgcctctgtgcca

SEQ ID NO: 977979 - DNA, 25 bp, Mus musculus
ttttatttatccacctctccaaaat

SEQ ID NO: 977980 - DNA, 25 bp, Mus musculus
ttttatttatcctcctctccaaaat

SEQ ID NO: 977981 - DNA, 25 bp, Mus musculus
ttttatttcaaaagccagtagctct

SEQ ID NO: 977982 - DNA, 25 bp, Mus musculus
ttttatttcaaatgccagtagctct

SEQ ID NO: 977983 - DNA, 25 bp, Mus musculus
ttttatttcagtacagccaaggtca

SEQ ID NO: 977984 - DNA, 25 bp, Mus musculus
ttttatttcagttcagccaaggtca

SEQ ID NO: 977985 - DNA, 25 bp, Mus musculus
ttttatttccacatggtaagccctg

SEQ ID NO: 977986 - DNA, 25 bp, Mus musculus
ttttatttccacttggtaagccctg

SEQ ID NO: 977987 - DNA, 25 bp, Mus musculus
ttttatttccagactacttgcagtg

SEQ ID NO: 977988 - DNA, 25 bp, Mus musculus
ttttatttccagtctacttgcagtg

SEQ ID NO: 977989 - DNA, 25 bp, Mus musculus
ttttatttctatagcttctttctag

SEQ ID NO: 977990 - DNA, 25 bp, Mus musculus
ttttatttctattgcttctttctag

SEQ ID NO: 977991 - DNA, 25 bp, Mus musculus
ttttatttcttacacccgcctctgg

SEQ ID NO: 977992 - DNA, 25 bp, Mus musculus
ttttatttcttagacccgcctctgg

SEQ ID NO: 977993 - DNA, 25 bp, Mus musculus
ttttatttcttccacctctgactct

SEQ ID NO: 977994 - DNA, 25 bp, Mus musculus
ttttatttcttcgacctctgactct

SEQ ID NO: 977995 - DNA, 25 bp, Mus musculus
ttttatttgcctaatccatctcact

SEQ ID NO: 977996 - DNA, 25 bp, Mus musculus
ttttatttgccttatccatctcact

SEQ ID NO: 977997 - DNA, 25 bp, Mus musculus
ttttattttacacacttcagttgac

SEQ ID NO: 977998 - DNA, 25 bp, Mus musculus
ttttattttacagacttcagttgac

SEQ ID NO: 977999 - DNA, 25 bp, Mus musculus
ttttattttctgattaatggcaagt

SEQ ID NO: 978000 - DNA, 25 bp, Mus musculus
ttttattttctgtttaatggcaagt

SEQ ID NO: 978001 - DNA, 25 bp, Mus musculus
ttttattttgcaatgtaccctaaag

SEQ ID NO: 978002 - DNA, 25 bp, Mus musculus
ttttattttgcattgtaccctaaag

SEQ ID NO: 978003 - DNA, 25 bp, Mus musculus
ttttattttgctctagccagcatac

SEQ ID NO: 978004 - DNA, 25 bp, Mus musculus
ttttattttgctgtagccagcatac

SEQ ID NO: 978005 - DNA, 25 bp, Mus musculus
ttttatttttgtaccgatgctctca

SEQ ID NO: 978006 - DNA, 25 bp, Mus musculus
ttttatttttgttccgatgctctca

SEQ ID NO: 978007 - DNA, 25 bp, Mus musculus
ttttcaaaaacacccctctgtgatt

SEQ ID NO: 978008 - DNA, 25 bp, Mus musculus
ttttcaaaaacagccctctgtgatt

SEQ ID NO: 978009 - DNA, 25 bp, Mus musculus
ttttcaaaacaaactgtagcagctc

SEQ ID NO: 978010 - DNA, 25 bp, Mus musculus
ttttcaaaacaatctgtagcagctc

SEQ ID NO: 978011 - DNA, 25 bp, Mus musculus
ttttcaaacttgatcctgctacctc

SEQ ID NO: 978012 - DNA, 25 bp, Mus musculus
ttttcaaacttgttcctgctacctc

SEQ ID NO: 978013 - DNA, 25 bp, Mus musculus
ttttcaaagacaacgacgacttcga

SEQ ID NO: 978014 - DNA, 25 bp, Mus musculus
ttttcaaagacatcgacgacttcga

SEQ ID NO: 978015 - DNA, 25 bp, Mus musculus
ttttcaaagctcacagcagatctgt

SEQ ID NO: 978016 - DNA, 25 bp, Mus musculus
ttttcaaagctctcagcagatctgt

SEQ ID NO: 978017 - DNA, 25 bp, Mus musculus
ttttcaaagggcagaaccttcattt

SEQ ID NO: 978018 - DNA, 25 bp, Mus musculus
ttttcaaagggctgaaccttcattt

SEQ ID NO: 978019 - DNA, 25 bp, Mus musculus
ttttcaaataacaccttctctccca

SEQ ID NO: 978020 - DNA, 25 bp, Mus musculus
ttttcaaataactccttctctccca

SEQ ID NO: 978021 - DNA, 25 bp, Mus musculus
ttttcaacaacgacaagctacagcg

SEQ ID NO: 978022 - DNA, 25 bp, Mus musculus
ttttcaacaacgtcaagctacagcg

SEQ ID NO: 978023 - DNA, 25 bp, Mus musculus
ttttcaacagtcagtccacaattct

SEQ ID NO: 978024 - DNA, 25 bp, Mus musculus
ttttcaacagtctgtccacaattct

SEQ ID NO: 978025 - DNA, 25 bp, Mus musculus
ttttcaacccaaattggttcatgta

SEQ ID NO: 978026 - DNA, 25 bp, Mus musculus
ttttcaacccaatttggttcatgta

SEQ ID NO: 978027 - DNA, 25 bp, Mus musculus
ttttcaacctcaaaaaccttcctgt

SEQ ID NO: 978028 - DNA, 25 bp, Mus musculus
ttttcaacctcataaaccttcctgt

SEQ ID NO: 978029 - DNA, 25 bp, Mus musculus
ttttcaacctgtatgggtgtgtgct

SEQ ID NO: 978030 - DNA, 25 bp, Mus musculus
ttttcaacctgtttgggtgtgtgct

SEQ ID NO: 978031 - DNA, 25 bp, Mus musculus
ttttcaactcttagtattgcttcaa

SEQ ID NO: 978032 - DNA, 25 bp, Mus musculus
ttttcaactctttgtattgcttcaa

SEQ ID NO: 978033 - DNA, 25 bp, Mus musculus
ttttcaactgacatcctctggagtg

SEQ ID NO: 978034 - DNA, 25 bp, Mus musculus
ttttcaactgacttcctctggagtg

SEQ ID NO: 978035 - DNA, 25 bp, Mus musculus
ttttcaacttaacggtgagcccacg

SEQ ID NO: 978036 - DNA, 25 bp, Mus musculus
ttttcaacttaagggtgagcccacg

SEQ ID NO: 978037 - DNA, 25 bp, Mus musculus
ttttcaacttatccttgtccactga

SEQ ID NO: 978038 - DNA, 25 bp, Mus musculus
ttttcaacttatgcttgtccactga

SEQ ID NO: 978039 - DNA, 25 bp, Mus musculus
ttttcaacttccagcctttcaaaca

SEQ ID NO: 978040 - DNA, 25 bp, Mus musculus
ttttcaacttcctgcctttcaaaca

SEQ ID NO: 978041 - DNA, 25 bp, Mus musculus
ttttcaacttgacagatgtctcctc

SEQ ID NO: 978042 - DNA, 25 bp, Mus musculus
ttttcaacttgagagatgtctcctc

SEQ ID NO: 978043 - DNA, 25 bp, Mus musculus
ttttcaacttggcacatcaggcacc

SEQ ID NO: 978044 - DNA, 25 bp, Mus musculus
ttttcaacttgggacatcaggcacc

SEQ ID NO: 978045 - DNA, 25 bp, Mus musculus
ttttcaagatgacttctcagctggg

SEQ ID NO: 978046 - DNA, 25 bp, Mus musculus
ttttcaagatgagttctcagctggg

SEQ ID NO: 978047 - DNA, 25 bp, Mus musculus
ttttcaagatttcttgtggtattct

SEQ ID NO: 978048 - DNA, 25 bp, Mus musculus
ttttcaagatttgttgtggtattct

SEQ ID NO: 978049 - DNA, 25 bp, Mus musculus
ttttcaagcactctcattgagatgc

SEQ ID NO: 978050 - DNA, 25 bp, Mus musculus
ttttcaagcactgtcattgagatgc

SEQ ID NO: 978051 - DNA, 25 bp, Mus musculus
ttttcaagccccagtccgagtgagt

SEQ ID NO: 978052 - DNA, 25 bp, Mus musculus
ttttcaagcccctgtccgagtgagt

SEQ ID NO: 978053 - DNA, 25 bp, Mus musculus
ttttcaaggaacaatcccctactgc

SEQ ID NO: 978054 - DNA, 25 bp, Mus musculus
ttttcaaggaactatcccctactgc

SEQ ID NO: 978055 - DNA, 25 bp, Mus musculus
ttttcaaggccaccatacgcagcat

SEQ ID NO: 978056 - DNA, 25 bp, Mus musculus
ttttcaaggccagcatacgcagcat

SEQ ID NO: 978057 - DNA, 25 bp, Mus musculus
ttttcaaggcttcacctctgctgcc

SEQ ID NO: 978058 - DNA, 25 bp, Mus musculus
ttttcaaggcttgacctctgctgcc

SEQ ID NO: 978059 - DNA, 25 bp, Mus musculus
ttttcaagggttcgcaggaggatac

SEQ ID NO: 978060 - DNA, 25 bp, Mus musculus
ttttcaagggttggcaggaggatac

SEQ ID NO: 978061 - DNA, 25 bp, Mus musculus
ttttcaaggtcgaggctgagatccc

SEQ ID NO: 978062 - DNA, 25 bp, Mus musculus
ttttcaaggtcgtggctgagatccc

SEQ ID NO: 978063 - DNA, 25 bp, Mus musculus
ttttcaaggtctaaaactgctgttg

SEQ ID NO: 978064 - DNA, 25 bp, Mus musculus
ttttcaaggtcttaaactgctgttg

SEQ ID NO: 978065 - DNA, 25 bp, Mus musculus
ttttcaagtgttatctccagtgttt

SEQ ID NO: 978066 - DNA, 25 bp, Mus musculus
ttttcaagtgttttctccagtgttt

SEQ ID NO: 978067 - DNA, 25 bp, Mus musculus
ttttcaagttcgatcctgcctgagt

SEQ ID NO: 978068 - DNA, 25 bp, Mus musculus
ttttcaagttcgttcctgcctgagt

SEQ ID NO: 978069 - DNA, 25 bp, Mus musculus
ttttcaagttgcacgatcctggcac

SEQ ID NO: 978070 - DNA, 25 bp, Mus musculus
ttttcaagttgctcgatcctggcac

SEQ ID NO: 978071 - DNA, 25 bp, Mus musculus
ttttcaatagccactaaccttgcct

SEQ ID NO: 978072 - DNA, 25 bp, Mus musculus
ttttcaatagcctctaaccttgcct

SEQ ID NO: 978073 - DNA, 25 bp, Mus musculus
ttttcaatcattctgcccttaaccg

SEQ ID NO: 978074 - DNA, 25 bp, Mus musculus
ttttcaatcattgtgcccttaaccg

SEQ ID NO: 978075 - DNA, 25 bp, Mus musculus
ttttcaatctggcatgtcttcacac

SEQ ID NO: 978076 - DNA, 25 bp, Mus musculus
ttttcaatctgggatgtcttcacac

SEQ ID NO: 978077 - DNA, 25 bp, Mus musculus
ttttcaatctttacccatcaggcag

SEQ ID NO: 978078 - DNA, 25 bp, Mus musculus
ttttcaatcttttcccatcaggcag

SEQ ID NO: 978079 - DNA, 25 bp, Mus musculus
ttttcaatgaatctgggtttgttac

SEQ ID NO: 978080 - DNA, 25 bp, Mus musculus
ttttcaatgaatgtgggtttgttac

SEQ ID NO: 978081 - DNA, 25 bp, Mus musculus
ttttcaatgccgatgtgtattctat

SEQ ID NO: 978082 - DNA, 25 bp, Mus musculus
ttttcaatgccgttgtgtattctat

SEQ ID NO: 978083 - DNA, 25 bp, Mus musculus
ttttcaatgctgctatatccaccca

SEQ ID NO: 978084 - DNA, 25 bp, Mus musculus
ttttcaatgctggtatatccaccca

SEQ ID NO: 978085 - DNA, 25 bp, Mus musculus
ttttcacaagtacacccacctgtaa

SEQ ID NO: 978086 - DNA, 25 bp, Mus musculus
ttttcacaagtagacccacctgtaa

SEQ ID NO: 978087 - DNA, 25 bp, Mus musculus
ttttcacactaacggcgaacttcca

SEQ ID NO: 978088 - DNA, 25 bp, Mus musculus
ttttcacactaagggcgaacttcca

SEQ ID NO: 978089 - DNA, 25 bp, Mus musculus
ttttcacagaaacattcctccaatg

SEQ ID NO: 978090 - DNA, 25 bp, Mus musculus
ttttcacagaaagattcctccaatg

SEQ ID NO: 978091 - DNA, 25 bp, Mus musculus
ttttcacagactcccatcttgctga

SEQ ID NO: 978092 - DNA, 25 bp, Mus musculus
ttttcacagactgccatcttgctga

SEQ ID NO: 978093 - DNA, 25 bp, Mus musculus
ttttcacagcagaacctccagtcag

SEQ ID NO: 978094 - DNA, 25 bp, Mus musculus
ttttcacagcagcagattttctgct

SEQ ID NO: 978095 - DNA, 25 bp, Mus musculus
ttttcacagcaggagattttctgct

SEQ ID NO: 978096 - DNA, 25 bp, Mus musculus
ttttcacagcagtacctccagtcag

SEQ ID NO: 978097 - DNA, 25 bp, Mus musculus
ttttcacagctaacacttacgggat

SEQ ID NO: 978098 - DNA, 25 bp, Mus musculus
ttttcacagctatcacttacgggat

SEQ ID NO: 978099 - DNA, 25 bp, Mus musculus
ttttcacagggcatatacacggaaa

SEQ ID NO: 978100 - DNA, 25 bp, Mus musculus
ttttcacagggcttatacacggaaa

SEQ ID NO: 978101 - DNA, 25 bp, Mus musculus
ttttcacattaacctggcctggcgg

SEQ ID NO: 978102 - DNA, 25 bp, Mus musculus
ttttcacattaactgcccgtctatg

SEQ ID NO: 978103 - DNA, 25 bp, Mus musculus
ttttcacattaagctggcctggcgg

SEQ ID NO: 978104 - DNA, 25 bp, Mus musculus
ttttcacattaagtgcccgtctatg

SEQ ID NO: 978105 - DNA, 25 bp, Mus musculus
ttttcacatttaatgctcctcttca

SEQ ID NO: 978106 - DNA, 25 bp, Mus musculus
ttttcacatttattgctcctcttca

SEQ ID NO: 978107 - DNA, 25 bp, Mus musculus
ttttcaccaagaacagaatttggac

SEQ ID NO: 978108 - DNA, 25 bp, Mus musculus
ttttcaccaagatcagaatttggac

SEQ ID NO: 978109 - DNA, 25 bp, Mus musculus
ttttcaccacttcgagcgactgttt

SEQ ID NO: 978110 - DNA, 25 bp, Mus musculus
ttttcaccacttggagcgactgttt

SEQ ID NO: 978111 - DNA, 25 bp, Mus musculus
ttttcaccagaaaccagcatgtatt

SEQ ID NO: 978112 - DNA, 25 bp, Mus musculus
ttttcaccagaatccagcatgtatt

SEQ ID NO: 978113 - DNA, 25 bp, Mus musculus
ttttcaccccaaatcttaagcttgc

SEQ ID NO: 978114 - DNA, 25 bp, Mus musculus
ttttcaccccaattcttaagcttgc

SEQ ID NO: 978115 - DNA, 25 bp, Mus musculus
ttttcacccggcctcggatgaacat

SEQ ID NO: 978116 - DNA, 25 bp, Mus musculus
ttttcacccggcgtcggatgaacat

SEQ ID NO: 978117 - DNA, 25 bp, Mus musculus
ttttcaccctcacaccctcttttca

SEQ ID NO: 978118 - DNA, 25 bp, Mus musculus
ttttcaccctcagaccctcttttca

SEQ ID NO: 978119 - DNA, 25 bp, Mus musculus
ttttcaccgaccctgactcccccat

SEQ ID NO: 978120 - DNA, 25 bp, Mus musculus
ttttcaccgaccgtgactcccccat

SEQ ID NO: 978121 - DNA, 25 bp, Mus musculus
ttttcacctaagctcaccccaatgg

SEQ ID NO: 978122 - DNA, 25 bp, Mus musculus
ttttcacctaaggtcaccccaatgg

SEQ ID NO: 978123 - DNA, 25 bp, Mus musculus
ttttcacctacaaccttgggccaaa

SEQ ID NO: 978124 - DNA, 25 bp, Mus musculus
ttttcacctacatccttgggccaaa

SEQ ID NO: 978125 - DNA, 25 bp, Mus musculus
ttttcacctatcctagcacaccaga

SEQ ID NO: 978126 - DNA, 25 bp, Mus musculus
ttttcacctatcgtagcacaccaga

SEQ ID NO: 978127 - DNA, 25 bp, Mus musculus
ttttcacctcccagcaagaagtttc

SEQ ID NO: 978128 - DNA, 25 bp, Mus musculus
ttttcacctccctgcaagaagtttc

SEQ ID NO: 978129 - DNA, 25 bp, Mus musculus
ttttcacctccgatataaagcccag

SEQ ID NO: 978130 - DNA, 25 bp, Mus musculus
ttttcacctccgttataaagcccag

SEQ ID NO: 978131 - DNA, 25 bp, Mus musculus
ttttcacctgaaattctgagttact

SEQ ID NO: 978132 - DNA, 25 bp, Mus musculus
ttttcacctgaatttctgagttact

SEQ ID NO: 978133 - DNA, 25 bp, Mus musculus
ttttcacctttgaagatcactatat

SEQ ID NO: 978134 - DNA, 25 bp, Mus musculus
ttttcacctttgtagatcactatat

SEQ ID NO: 978135 - DNA, 25 bp, Mus musculus
ttttcaccttttaagatgtcttctt

SEQ ID NO: 978136 - DNA, 25 bp, Mus musculus
ttttcacctttttagatgtcttctt

SEQ ID NO: 978137 - DNA, 25 bp, Mus musculus
ttttcacgacacctaaactgggctg

SEQ ID NO: 978138 - DNA, 25 bp, Mus musculus
ttttcacgacacgtaaactgggctg

SEQ ID NO: 978139 - DNA, 25 bp, Mus musculus
ttttcacgacagagtcatctccaga

SEQ ID NO: 978140 - DNA, 25 bp, Mus musculus
ttttcacgacagtgtcatctccaga

SEQ ID NO: 978141 - DNA, 25 bp, Mus musculus
ttttcacggatgaatgatctgtcat

SEQ ID NO: 978142 - DNA, 25 bp, Mus musculus
ttttcacggatgtatgatctgtcat

SEQ ID NO: 978143 - DNA, 25 bp, Mus musculus
ttttcacgggatctgttagtttcaa

SEQ ID NO: 978144 - DNA, 25 bp, Mus musculus
ttttcacgggatgtgttagtttcaa

SEQ ID NO: 978145 - DNA, 25 bp, Mus musculus
ttttcacgtactctgtttcacatgt

SEQ ID NO: 978146 - DNA, 25 bp, Mus musculus
ttttcacgtactgtgtttcacatgt

SEQ ID NO: 978147 - DNA, 25 bp, Mus musculus
ttttcactccccagctatcaagaat

SEQ ID NO: 978148 - DNA, 25 bp, Mus musculus
ttttcactcccctgctatcaagaat

SEQ ID NO: 978149 - DNA, 25 bp, Mus musculus
ttttcactgatgatcacgatgtgct

SEQ ID NO: 978150 - DNA, 25 bp, Mus musculus
ttttcactgatgttcacgatgtgct

SEQ ID NO: 978151 - DNA, 25 bp, Mus musculus
ttttcactgattacctaagcatagc

SEQ ID NO: 978152 - DNA, 25 bp, Mus musculus
ttttcactgatttcctaagcatagc

SEQ ID NO: 978153 - DNA, 25 bp, Mus musculus
ttttcactgccaaccccaaggccat

SEQ ID NO: 978154 - DNA, 25 bp, Mus musculus
ttttcactgccatccccaaggccat

SEQ ID NO: 978155 - DNA, 25 bp, Mus musculus
ttttcactgctgctccgtacgttat

SEQ ID NO: 978156 - DNA, 25 bp, Mus musculus
ttttcactgctggtccgtacgttat

SEQ ID NO: 978157 - DNA, 25 bp, Mus musculus
ttttcacttcaaatgattccttcta

SEQ ID NO: 978158 - DNA, 25 bp, Mus musculus
ttttcacttcaattgattccttcta

SEQ ID NO: 978159 - DNA, 25 bp, Mus musculus
ttttcacttcacactttgtttctgt

SEQ ID NO: 978160 - DNA, 25 bp, Mus musculus
ttttcacttcactctttgtttctgt

SEQ ID NO: 978161 - DNA, 25 bp, Mus musculus
ttttcacttccaatatgaaggcctt

SEQ ID NO: 978162 - DNA, 25 bp, Mus musculus
ttttcacttccattatgaaggcctt

SEQ ID NO: 978163 - DNA, 25 bp, Mus musculus
ttttcacttctactttttcctagca

SEQ ID NO: 978164 - DNA, 25 bp, Mus musculus
ttttcacttctagtttttcctagca

SEQ ID NO: 978165 - DNA, 25 bp, Mus musculus
ttttcacttgctatcaatatgatga

SEQ ID NO: 978166 - DNA, 25 bp, Mus musculus
ttttcacttgctttcaatatgatga

SEQ ID NO: 978167 - DNA, 25 bp, Mus musculus
ttttcacttggactcacagtcctga

SEQ ID NO: 978168 - DNA, 25 bp, Mus musculus
ttttcacttggagtcacagtcctga

SEQ ID NO: 978169 - DNA, 25 bp, Mus musculus
ttttcacttggtctctgtttacagc

SEQ ID NO: 978170 - DNA, 25 bp, Mus musculus
ttttcacttggtgtctgtttacagc

SEQ ID NO: 978171 - DNA, 25 bp, Mus musculus
ttttcacttgtaactcttctcctgt

SEQ ID NO: 978172 - DNA, 25 bp, Mus musculus
ttttcacttgtatctcttctcctgt

SEQ ID NO: 978173 - DNA, 25 bp, Mus musculus
ttttcactttatcgtttctttatag

SEQ ID NO: 978174 - DNA, 25 bp, Mus musculus
ttttcactttatggtttctttatag

SEQ ID NO: 978175 - DNA, 25 bp, Mus musculus
ttttcactttctatgtattattata

SEQ ID NO: 978176 - DNA, 25 bp, Mus musculus
ttttcactttctttgtattattata

SEQ ID NO: 978177 - DNA, 25 bp, Mus musculus
ttttcactttgtagctcttggatct

SEQ ID NO: 978178 - DNA, 25 bp, Mus musculus
ttttcactttgttgctcttggatct

SEQ ID NO: 978179 - DNA, 25 bp, Mus musculus
ttttcagaaactaaacacttggata

SEQ ID NO: 978180 - DNA, 25 bp, Mus musculus
ttttcagaaacttaacacttggata

SEQ ID NO: 978181 - DNA, 25 bp, Mus musculus
ttttcagaaatccctaagattaact

SEQ ID NO: 978182 - DNA, 25 bp, Mus musculus
ttttcagaaatcgctaagattaact

SEQ ID NO: 978183 - DNA, 25 bp, Mus musculus
ttttcagaacaacaagaggatatgc

SEQ ID NO: 978184 - DNA, 25 bp, Mus musculus
ttttcagaacaagaagaggatatgc

SEQ ID NO: 978185 - DNA, 25 bp, Mus musculus
ttttcagaacccagggctgggacag

SEQ ID NO: 978186 - DNA, 25 bp, Mus musculus
ttttcagaaccctgggctgggacag

SEQ ID NO: 978187 - DNA, 25 bp, Mus musculus
ttttcagaacctccacagctgtcat

SEQ ID NO: 978188 - DNA, 25 bp, Mus musculus
ttttcagaacctgcacagctgtcat

SEQ ID NO: 978189 - DNA, 25 bp, Mus musculus
ttttcagaagttactcgcgtggccg

SEQ ID NO: 978190 - DNA, 25 bp, Mus musculus
ttttcagaagtttctcgcgtggccg

SEQ ID NO: 978191 - DNA, 25 bp, Mus musculus
ttttcagaataaaagcagctgatgt

SEQ ID NO: 978192 - DNA, 25 bp, Mus musculus
ttttcagaataatagcagctgatgt

SEQ ID NO: 978193 - DNA, 25 bp, Mus musculus
ttttcagaatggatactccccgcaa

SEQ ID NO: 978194 - DNA, 25 bp, Mus musculus
ttttcagaatggttactccccgcaa

SEQ ID NO: 978195 - DNA, 25 bp, Mus musculus
ttttcagacctcctttgagtttgaa

SEQ ID NO: 978196 - DNA, 25 bp, Mus musculus
ttttcagacctcgtttgagtttgaa

SEQ ID NO: 978197 - DNA, 25 bp, Mus musculus
ttttcagactttatgttactacaga

SEQ ID NO: 978198 - DNA, 25 bp, Mus musculus
ttttcagactttttgttactacaga

SEQ ID NO: 978199 - DNA, 25 bp, Mus musculus
ttttcagagtctataccctatcgta

SEQ ID NO: 978200 - DNA, 25 bp, Mus musculus
ttttcagagtctttaccctatcgta

SEQ ID NO: 978201 - DNA, 25 bp, Mus musculus
ttttcagagtgcacctatctacctg

SEQ ID NO: 978202 - DNA, 25 bp, Mus musculus
ttttcagagtgctcctatctacctg

SEQ ID NO: 978203 - DNA, 25 bp, Mus musculus
ttttcagagttcatttcaaacccag

SEQ ID NO: 978204 - DNA, 25 bp, Mus musculus
ttttcagagttcttttcaaacccag

SEQ ID NO: 978205 - DNA, 25 bp, Mus musculus
ttttcagataacattagcggctcat

SEQ ID NO: 978206 - DNA, 25 bp, Mus musculus
ttttcagataactttagcggctcat

SEQ ID NO: 978207 - DNA, 25 bp, Mus musculus
ttttcagatgagatctcctgcccgc

SEQ ID NO: 978208 - DNA, 25 bp, Mus musculus
ttttcagatgagttctcctgcccgc

SEQ ID NO: 978209 - DNA, 25 bp, Mus musculus
ttttcagatgtcagccaagggcacc

SEQ ID NO: 978210 - DNA, 25 bp, Mus musculus
ttttcagatgtctgccaagggcacc

SEQ ID NO: 978211 - DNA, 25 bp, Mus musculus
ttttcagcagaaccctacacgccta

SEQ ID NO: 978212 - DNA, 25 bp, Mus musculus
ttttcagcagaagcctacacgccta

SEQ ID NO: 978213 - DNA, 25 bp, Mus musculus
ttttcagcagatattttgcacagag

SEQ ID NO: 978214 - DNA, 25 bp, Mus musculus
ttttcagcagattttttgcacagag

SEQ ID NO: 978215 - DNA, 25 bp, Mus musculus
ttttcagcagtgactttccttgacg

SEQ ID NO: 978216 - DNA, 25 bp, Mus musculus
ttttcagcagtgcatgtggccctgg

SEQ ID NO: 978217 - DNA, 25 bp, Mus musculus
ttttcagcagtggatgtggccctgg

SEQ ID NO: 978218 - DNA, 25 bp, Mus musculus
ttttcagcagtgtctttccttgacg

SEQ ID NO: 978219 - DNA, 25 bp, Mus musculus
ttttcagccccaacaaacacaggca

SEQ ID NO: 978220 - DNA, 25 bp, Mus musculus
ttttcagccccatcaaacacaggca

SEQ ID NO: 978221 - DNA, 25 bp, Mus musculus
ttttcagcccgacccgacggcggag

SEQ ID NO: 978222 - DNA, 25 bp, Mus musculus
ttttcagcccgagccgacggcggag

SEQ ID NO: 978223 - DNA, 25 bp, Mus musculus
ttttcagcctctaaactgagtaggt

SEQ ID NO: 978224 - DNA, 25 bp, Mus musculus
ttttcagcctcttaactgagtaggt

SEQ ID NO: 978225 - DNA, 25 bp, Mus musculus
ttttcagcggagagtgtcccagcac

SEQ ID NO: 978226 - DNA, 25 bp, Mus musculus
ttttcagcggagtgtgtcccagcac

SEQ ID NO: 978227 - DNA, 25 bp, Mus musculus
ttttcagctcccagcttgggtggct

SEQ ID NO: 978228 - DNA, 25 bp, Mus musculus
ttttcagctccctgcttgggtggct

SEQ ID NO: 978229 - DNA, 25 bp, Mus musculus
ttttcagctcttcctaatttacttt

SEQ ID NO: 978230 - DNA, 25 bp, Mus musculus
ttttcagctcttgctaatttacttt

SEQ ID NO: 978231 - DNA, 25 bp, Mus musculus
ttttcagctgctacagtataaggtg

SEQ ID NO: 978232 - DNA, 25 bp, Mus musculus
ttttcagctgcttcagtataaggtg

SEQ ID NO: 978233 - DNA, 25 bp, Mus musculus
ttttcagcttgcaataaccccttcc

SEQ ID NO: 978234 - DNA, 25 bp, Mus musculus
ttttcagcttgctataaccccttcc

SEQ ID NO: 978235 - DNA, 25 bp, Mus musculus
ttttcaggaagacctaacatttagt

SEQ ID NO: 978236 - DNA, 25 bp, Mus musculus
ttttcaggaagagctaacatttagt

SEQ ID NO: 978237 - DNA, 25 bp, Mus musculus
ttttcaggagacagaagacgggatc

SEQ ID NO: 978238 - DNA, 25 bp, Mus musculus
ttttcaggagactgaagacgggatc

SEQ ID NO: 978239 - DNA, 25 bp, Mus musculus
ttttcaggagcgcaagatagatttg

SEQ ID NO: 978240 - DNA, 25 bp, Mus musculus
ttttcaggagcggaagatagatttg

SEQ ID NO: 978241 - DNA, 25 bp, Mus musculus
ttttcaggcgcaaaagactgcatcc

SEQ ID NO: 978242 - DNA, 25 bp, Mus musculus
ttttcaggcgcataagactgcatcc

SEQ ID NO: 978243 - DNA, 25 bp, Mus musculus
ttttcaggctcaccaacgctggcat

SEQ ID NO: 978244 - DNA, 25 bp, Mus musculus
ttttcaggctcagcaacgctggcat

SEQ ID NO: 978245 - DNA, 25 bp, Mus musculus
ttttcaggctgacggtcctgttgag

SEQ ID NO: 978246 - DNA, 25 bp, Mus musculus
ttttcaggctgagggtcctgttgag

SEQ ID NO: 978247 - DNA, 25 bp, Mus musculus
ttttcagggcaccaaagctgcatgc

SEQ ID NO: 978248 - DNA, 25 bp, Mus musculus
ttttcagggcacgaaagctgcatgc

SEQ ID NO: 978249 - DNA, 25 bp, Mus musculus
ttttcagggcttctagcctccggct

SEQ ID NO: 978250 - DNA, 25 bp, Mus musculus
ttttcagggcttgtagcctccggct

SEQ ID NO: 978251 - DNA, 25 bp, Mus musculus
ttttcaggggctacaactacagtta

SEQ ID NO: 978252 - DNA, 25 bp, Mus musculus
ttttcaggggcttcaactacagtta

SEQ ID NO: 978253 - DNA, 25 bp, Mus musculus
ttttcagggtacaactcagttccag

SEQ ID NO: 978254 - DNA, 25 bp, Mus musculus
ttttcagggtactactcagttccag

SEQ ID NO: 978255 - DNA, 25 bp, Mus musculus
ttttcagggtgcattttaaatacta

SEQ ID NO: 978256 - DNA, 25 bp, Mus musculus
ttttcagggtgctttttaaatacta

SEQ ID NO: 978257 - DNA, 25 bp, Mus musculus
ttttcagggtttctggtttgcacct

SEQ ID NO: 978258 - DNA, 25 bp, Mus musculus
ttttcagggtttgtggtttgcacct

SEQ ID NO: 978259 - DNA, 25 bp, Mus musculus
ttttcaggtcacctagcatctgcca

SEQ ID NO: 978260 - DNA, 25 bp, Mus musculus
ttttcaggtcacgtagcatctgcca

SEQ ID NO: 978261 - DNA, 25 bp, Mus musculus
ttttcaggtctgcatattggtggca

SEQ ID NO: 978262 - DNA, 25 bp, Mus musculus
ttttcaggtctgctgaggtgttcat

SEQ ID NO: 978263 - DNA, 25 bp, Mus musculus
ttttcaggtctggatattggtggca

SEQ ID NO: 978264 - DNA, 25 bp, Mus musculus
ttttcaggtctggtgaggtgttcat

SEQ ID NO: 978265 - DNA, 25 bp, Mus musculus
ttttcaggtcttacgtggtcagtaa

SEQ ID NO: 978266 - DNA, 25 bp, Mus musculus
ttttcaggtctttcgtggtcagtaa

SEQ ID NO: 978267 - DNA, 25 bp, Mus musculus
ttttcagtaaatctttcgtacaaat

SEQ ID NO: 978268 - DNA, 25 bp, Mus musculus
ttttcagtaaatgtttcgtacaaat

SEQ ID NO: 978269 - DNA, 25 bp, Mus musculus
ttttcagtaatactccgaagtggga

SEQ ID NO: 978270 - DNA, 25 bp, Mus musculus
ttttcagtaatagtccgaagtggga

SEQ ID NO: 978271 - DNA, 25 bp, Mus musculus
ttttcagtaccacaccagtttttcg

SEQ ID NO: 978272 - DNA, 25 bp, Mus musculus
ttttcagtaccagaccagtttttcg

SEQ ID NO: 978273 - DNA, 25 bp, Mus musculus
ttttcagtagcaattttgtgtgact

SEQ ID NO: 978274 - DNA, 25 bp, Mus musculus
ttttcagtagcatttttgtgtgact

SEQ ID NO: 978275 - DNA, 25 bp, Mus musculus
ttttcagtctaaaggctttttaaca

SEQ ID NO: 978276 - DNA, 25 bp, Mus musculus
ttttcagtctaatggctttttaaca

SEQ ID NO: 978277 - DNA, 25 bp, Mus musculus
ttttcagtctatagtcagcaggccc

SEQ ID NO: 978278 - DNA, 25 bp, Mus musculus
ttttcagtctattgtcagcaggccc

SEQ ID NO: 978279 - DNA, 25 bp, Mus musculus
ttttcagtgtcaacgaagggtctct

SEQ ID NO: 978280 - DNA, 25 bp, Mus musculus
ttttcagtgtcatcgaagggtctct

SEQ ID NO: 978281 - DNA, 25 bp, Mus musculus
ttttcagtgtttctggcctttggaa

SEQ ID NO: 978282 - DNA, 25 bp, Mus musculus
ttttcagtgtttgtggcctttggaa

SEQ ID NO: 978283 - DNA, 25 bp, Mus musculus
ttttcagttacacggagagactcat

SEQ ID NO: 978284 - DNA, 25 bp, Mus musculus
ttttcagttacagggagagactcat

SEQ ID NO: 978285 - DNA, 25 bp, Mus musculus
ttttcagttgtcaactaggttttgt

SEQ ID NO: 978286 - DNA, 25 bp, Mus musculus
ttttcagttgtcaggcttgcatggc

SEQ ID NO: 978287 - DNA, 25 bp, Mus musculus
ttttcagttgtctactaggttttgt

SEQ ID NO: 978288 - DNA, 25 bp, Mus musculus
ttttcagttgtctggcttgcatggc

SEQ ID NO: 978289 - DNA, 25 bp, Mus musculus
ttttcagtttgaatgtctatgcgga

SEQ ID NO: 978290 - DNA, 25 bp, Mus musculus
ttttcagtttgattgtctatgcgga

SEQ ID NO: 978291 - DNA, 25 bp, Mus musculus
ttttcataagttattcagacaggtg

SEQ ID NO: 978292 - DNA, 25 bp, Mus musculus
ttttcataagtttttcagacaggtg

SEQ ID NO: 978293 - DNA, 25 bp, Mus musculus
ttttcatacaatctctcctgctaag

SEQ ID NO: 978294 - DNA, 25 bp, Mus musculus
ttttcatacaatgtctcctgctaag

SEQ ID NO: 978295 - DNA, 25 bp, Mus musculus
ttttcatacactagattgtctgcat

SEQ ID NO: 978296 - DNA, 25 bp, Mus musculus
ttttcatacacttgattgtctgcat

SEQ ID NO: 978297 - DNA, 25 bp, Mus musculus
ttttcatactttactacttctgtgt

SEQ ID NO: 978298 - DNA, 25 bp, Mus musculus
ttttcatacttttctacttctgtgt

SEQ ID NO: 978299 - DNA, 25 bp, Mus musculus
ttttcatatgaaattgttaatcctg

SEQ ID NO: 978300 - DNA, 25 bp, Mus musculus
ttttcatatgaatttgttaatcctg

SEQ ID NO: 978301 - DNA, 25 bp, Mus musculus
ttttcatatgacacacaggtatttt

SEQ ID NO: 978302 - DNA, 25 bp, Mus musculus
ttttcatatgaccagcagaaatata

SEQ ID NO: 978303 - DNA, 25 bp, Mus musculus
ttttcatatgacgagcagaaatata

SEQ ID NO: 978304 - DNA, 25 bp, Mus musculus
ttttcatatgactcacaggtatttt

SEQ ID NO: 978305 - DNA, 25 bp, Mus musculus
ttttcatattgtaactagatcaccc

SEQ ID NO: 978306 - DNA, 25 bp, Mus musculus
ttttcatattgttactagatcaccc

SEQ ID NO: 978307 - DNA, 25 bp, Mus musculus
ttttcatcaactcaggatccagcag

SEQ ID NO: 978308 - DNA, 25 bp, Mus musculus
ttttcatcaactgaggatccagcag

SEQ ID NO: 978309 - DNA, 25 bp, Mus musculus
ttttcatcaaggctgacacttccgg

SEQ ID NO: 978310 - DNA, 25 bp, Mus musculus
ttttcatcaagggtgacacttccgg

SEQ ID NO: 978311 - DNA, 25 bp, Mus musculus
ttttcatcaatgcagactggcgtct

SEQ ID NO: 978312 - DNA, 25 bp, Mus musculus
ttttcatcaatggagactggcgtct

SEQ ID NO: 978313 - DNA, 25 bp, Mus musculus
ttttcatcaccactagtaccagcat

SEQ ID NO: 978314 - DNA, 25 bp, Mus musculus
ttttcatcaccagtagtaccagcat

SEQ ID NO: 978315 - DNA, 25 bp, Mus musculus
ttttcatcactcacagggtcacagt

SEQ ID NO: 978316 - DNA, 25 bp, Mus musculus
ttttcatcactctcagggtcacagt

SEQ ID NO: 978317 - DNA, 25 bp, Mus musculus
ttttcatcagcaaggctctgcccat

SEQ ID NO: 978318 - DNA, 25 bp, Mus musculus
ttttcatcagcatggctctgcccat

SEQ ID NO: 978319 - DNA, 25 bp, Mus musculus
ttttcatcattccatcatttccagt

SEQ ID NO: 978320 - DNA, 25 bp, Mus musculus
ttttcatcattcgatcatttccagt

SEQ ID NO: 978321 - DNA, 25 bp, Mus musculus
ttttcatcatttccccatcattaca

SEQ ID NO: 978322 - DNA, 25 bp, Mus musculus
ttttcatcatttgcccatcattaca

SEQ ID NO: 978323 - DNA, 25 bp, Mus musculus
ttttcatcctggctgctatccttag

SEQ ID NO: 978324 - DNA, 25 bp, Mus musculus
ttttcatcctgggtgctatccttag

SEQ ID NO: 978325 - DNA, 25 bp, Mus musculus
ttttcatcgagaacgcctacaagcg

SEQ ID NO: 978326 - DNA, 25 bp, Mus musculus
ttttcatcgagatcgcctacaagcg

SEQ ID NO: 978327 - DNA, 25 bp, Mus musculus
ttttcatcgttgacggtgccacaga

SEQ ID NO: 978328 - DNA, 25 bp, Mus musculus
ttttcatcgttgtcggtgccacaga

SEQ ID NO: 978329 - DNA, 25 bp, Mus musculus
ttttcatctactcatttctggtgca

SEQ ID NO: 978330 - DNA, 25 bp, Mus musculus
ttttcatctactgatttctggtgca

SEQ ID NO: 978331 - DNA, 25 bp, Mus musculus
ttttcatctgcaagaggccctacgt

SEQ ID NO: 978332 - DNA, 25 bp, Mus musculus
ttttcatctgcatgaggccctacgt

SEQ ID NO: 978333 - DNA, 25 bp, Mus musculus
ttttcatctttcctatgaagccaga

SEQ ID NO: 978334 - DNA, 25 bp, Mus musculus
ttttcatctttcgtatgaagccaga

SEQ ID NO: 978335 - DNA, 25 bp, Mus musculus
ttttcatctttgactgtggccccaa

SEQ ID NO: 978336 - DNA, 25 bp, Mus musculus
ttttcatctttgtctgtggccccaa

SEQ ID NO: 978337 - DNA, 25 bp, Mus musculus
ttttcatgaaaaccttctccattgc

SEQ ID NO: 978338 - DNA, 25 bp, Mus musculus
ttttcatgaaaagcttctccattgc

SEQ ID NO: 978339 - DNA, 25 bp, Mus musculus
ttttcatgaatgataagcagcagca

SEQ ID NO: 978340 - DNA, 25 bp, Mus musculus
ttttcatgaatgttaagcagcagca

SEQ ID NO: 978341 - DNA, 25 bp, Mus musculus
ttttcatgacagatgtctcctccat

SEQ ID NO: 978342 - DNA, 25 bp, Mus musculus
ttttcatgacagttgtctcctccat

SEQ ID NO: 978343 - DNA, 25 bp, Mus musculus
ttttcatgattcacactgttctgtg

SEQ ID NO: 978344 - DNA, 25 bp, Mus musculus
ttttcatgattctcactgttctgtg

SEQ ID NO: 978345 - DNA, 25 bp, Mus musculus
ttttcatgctttacttcccgtgtca

SEQ ID NO: 978346 - DNA, 25 bp, Mus musculus
ttttcatgcttttcttcccgtgtca

SEQ ID NO: 978347 - DNA, 25 bp, Mus musculus
ttttcatggataacaagatgcccaa

SEQ ID NO: 978348 - DNA, 25 bp, Mus musculus
ttttcatggatatcaagatgcccaa

SEQ ID NO: 978349 - DNA, 25 bp, Mus musculus
ttttcatggctgcatcgtcacacat

SEQ ID NO: 978350 - DNA, 25 bp, Mus musculus
ttttcatggctggatcgtcacacat

SEQ ID NO: 978351 - DNA, 25 bp, Mus musculus
ttttcatggtatcttcaatccaggg

SEQ ID NO: 978352 - DNA, 25 bp, Mus musculus
ttttcatggtatgttcaatccaggg

SEQ ID NO: 978353 - DNA, 25 bp, Mus musculus
ttttcatgtcctcacccatgtcctg

SEQ ID NO: 978354 - DNA, 25 bp, Mus musculus
ttttcatgtcctgacccatgtcctg

SEQ ID NO: 978355 - DNA, 25 bp, Mus musculus
ttttcatgtctaagtgcctcacaag

SEQ ID NO: 978356 - DNA, 25 bp, Mus musculus
ttttcatgtctatgtgcctcacaag

SEQ ID NO: 978357 - DNA, 25 bp, Mus musculus
ttttcatgtgccctccctgtatttc

SEQ ID NO: 978358 - DNA, 25 bp, Mus musculus
ttttcatgtgccgtccctgtatttc

SEQ ID NO: 978359 - DNA, 25 bp, Mus musculus
ttttcatgttatctaaagttactgc

SEQ ID NO: 978360 - DNA, 25 bp, Mus musculus
ttttcatgttatgtaaagttactgc

SEQ ID NO: 978361 - DNA, 25 bp, Mus musculus
ttttcatgttttcacttagctataa

SEQ ID NO: 978362 - DNA, 25 bp, Mus musculus
ttttcatgttttgacttagctataa

SEQ ID NO: 978363 - DNA, 25 bp, Mus musculus
ttttcattactccaggttgccttca

SEQ ID NO: 978364 - DNA, 25 bp, Mus musculus
ttttcattactcgaggttgccttca

SEQ ID NO: 978365 - DNA, 25 bp, Mus musculus
ttttcattagcaaagtagccctttc

SEQ ID NO: 978366 - DNA, 25 bp, Mus musculus
ttttcattagcatagtagccctttc

SEQ ID NO: 978367 - DNA, 25 bp, Mus musculus
ttttcattcacgataagctgctttc

SEQ ID NO: 978368 - DNA, 25 bp, Mus musculus
ttttcattcacgttaagctgctttc

SEQ ID NO: 978369 - DNA, 25 bp, Mus musculus
ttttcattccctcggctcataacaa

SEQ ID NO: 978370 - DNA, 25 bp, Mus musculus
ttttcattccctcttctgtgacaca

SEQ ID NO: 978371 - DNA, 25 bp, Mus musculus
ttttcattccctgggctcataacaa

SEQ ID NO: 978372 - DNA, 25 bp, Mus musculus
ttttcattccctgttctgtgacaca

SEQ ID NO: 978373 - DNA, 25 bp, Mus musculus
ttttcattcttaatttagttctagt

SEQ ID NO: 978374 - DNA, 25 bp, Mus musculus
ttttcattcttattttagttctagt

SEQ ID NO: 978375 - DNA, 25 bp, Mus musculus
ttttcattcttcctgctacagtgaa

SEQ ID NO: 978376 - DNA, 25 bp, Mus musculus
ttttcattcttcgtgctacagtgaa

SEQ ID NO: 978377 - DNA, 25 bp, Mus musculus
ttttcattgcagacctacaccagag

SEQ ID NO: 978378 - DNA, 25 bp, Mus musculus
ttttcattgcagtcctacaccagag

SEQ ID NO: 978379 - DNA, 25 bp, Mus musculus
ttttcattggaaacagtgactgaga

SEQ ID NO: 978380 - DNA, 25 bp, Mus musculus
ttttcattggaatcagtgactgaga

SEQ ID NO: 978381 - DNA, 25 bp, Mus musculus
ttttcattggctacccttggtccat

SEQ ID NO: 978382 - DNA, 25 bp, Mus musculus
ttttcattggcttcccttggtccat

SEQ ID NO: 978383 - DNA, 25 bp, Mus musculus
ttttcattgtgtactcgcttaagga

SEQ ID NO: 978384 - DNA, 25 bp, Mus musculus
ttttcattgtgttctcgcttaagga

SEQ ID NO: 978385 - DNA, 25 bp, Mus musculus
ttttcatttcttcgaaggccatgga

SEQ ID NO: 978386 - DNA, 25 bp, Mus musculus
ttttcatttcttggaaggccatgga

SEQ ID NO: 978387 - DNA, 25 bp, Mus musculus
ttttcatttgaacgagcggagcgtg

SEQ ID NO: 978388 - DNA, 25 bp, Mus musculus
ttttcatttgaaggagcggagcgtg

SEQ ID NO: 978389 - DNA, 25 bp, Mus musculus
ttttcattttacagcttcaaaccca

SEQ ID NO: 978390 - DNA, 25 bp, Mus musculus
ttttcattttactgcttcaaaccca

SEQ ID NO: 978391 - DNA, 25 bp, Mus musculus
ttttcattttgacagaggcccatag

SEQ ID NO: 978392 - DNA, 25 bp, Mus musculus
ttttcattttgagagaggcccatag

SEQ ID NO: 978393 - DNA, 25 bp, Mus musculus
ttttccaaaaagatgcccgtagatg

SEQ ID NO: 978394 - DNA, 25 bp, Mus musculus
ttttccaaaaagttgcccgtagatg

SEQ ID NO: 978395 - DNA, 25 bp, Mus musculus
ttttccaaaaccaattggtgctcaa

SEQ ID NO: 978396 - DNA, 25 bp, Mus musculus
ttttccaaaacctattggtgctcaa

SEQ ID NO: 978397 - DNA, 25 bp, Mus musculus
ttttccaaaggtcgcatggtcctca

SEQ ID NO: 978398 - DNA, 25 bp, Mus musculus
ttttccaaaggtggcatggtcctca

SEQ ID NO: 978399 - DNA, 25 bp, Mus musculus
ttttccaaatgtcaaagccatatgt

SEQ ID NO: 978400 - DNA, 25 bp, Mus musculus
ttttccaaatgtgaaagccatatgt

SEQ ID NO: 978401 - DNA, 25 bp, Mus musculus
ttttccaaattgatgtctattgttt

SEQ ID NO: 978402 - DNA, 25 bp, Mus musculus
ttttccaaattgttgtctattgttt

SEQ ID NO: 978403 - DNA, 25 bp, Mus musculus
ttttccaacattatgaacaatgcct

SEQ ID NO: 978404 - DNA, 25 bp, Mus musculus
ttttccaacattttgaacaatgcct

SEQ ID NO: 978405 - DNA, 25 bp, Mus musculus
ttttccaaccatagcaggtcatcta

SEQ ID NO: 978406 - DNA, 25 bp, Mus musculus
ttttccaaccatctgcaagcagtgt

SEQ ID NO: 978407 - DNA, 25 bp, Mus musculus
ttttccaaccatgtgcaagcagtgt

SEQ ID NO: 978408 - DNA, 25 bp, Mus musculus
ttttccaaccattgcaggtcatcta

SEQ ID NO: 978409 - DNA, 25 bp, Mus musculus
ttttccaacctaaagcttaatatat

SEQ ID NO: 978410 - DNA, 25 bp, Mus musculus
ttttccaacctatagcttaatatat

SEQ ID NO: 978411 - DNA, 25 bp, Mus musculus
ttttccaacctgcagcttgcttgag

SEQ ID NO: 978412 - DNA, 25 bp, Mus musculus
ttttccaacctggagcttgcttgag

SEQ ID NO: 978413 - DNA, 25 bp, Mus musculus
ttttccaagacacattgagttcctg

SEQ ID NO: 978414 - DNA, 25 bp, Mus musculus
ttttccaagacagattgagttcctg

SEQ ID NO: 978415 - DNA, 25 bp, Mus musculus
ttttccaagagcagagttagctgtg

SEQ ID NO: 978416 - DNA, 25 bp, Mus musculus
ttttccaagagctgagttagctgtg

SEQ ID NO: 978417 - DNA, 25 bp, Mus musculus
ttttccaaggaaactgcgtgtgccc

SEQ ID NO: 978418 - DNA, 25 bp, Mus musculus
ttttccaaggaatctgcgtgtgccc

SEQ ID NO: 978419 - DNA, 25 bp, Mus musculus
ttttccaaggagctacagaatctgt

SEQ ID NO: 978420 - DNA, 25 bp, Mus musculus
ttttccaaggaggtacagaatctgt

SEQ ID NO: 978421 - DNA, 25 bp, Mus musculus
ttttccaagttacatttactgcaga

SEQ ID NO: 978422 - DNA, 25 bp, Mus musculus
ttttccaagttagatttactgcaga

SEQ ID NO: 978423 - DNA, 25 bp, Mus musculus
ttttccaagtttcctgtgcatcaca

SEQ ID NO: 978424 - DNA, 25 bp, Mus musculus
ttttccaagtttgctgtgcatcaca

SEQ ID NO: 978425 - DNA, 25 bp, Mus musculus
ttttccaatactagaggccctccct

SEQ ID NO: 978426 - DNA, 25 bp, Mus musculus
ttttccaatacttgaggccctccct

SEQ ID NO: 978427 - DNA, 25 bp, Mus musculus
ttttccaatcaacctgtttcccctg

SEQ ID NO: 978428 - DNA, 25 bp, Mus musculus
ttttccaatcaagctgtttcccctg

SEQ ID NO: 978429 - DNA, 25 bp, Mus musculus
ttttccaatcttcaccaagccattc

SEQ ID NO: 978430 - DNA, 25 bp, Mus musculus
ttttccaatcttgaccaagccattc

SEQ ID NO: 978431 - DNA, 25 bp, Mus musculus
ttttccaatgtaatagccgtcttct

SEQ ID NO: 978432 - DNA, 25 bp, Mus musculus
ttttccaatgtattagccgtcttct

SEQ ID NO: 978433 - DNA, 25 bp, Mus musculus
ttttccaatgttaaggctttccttg

SEQ ID NO: 978434 - DNA, 25 bp, Mus musculus
ttttccaatgtttaggctttccttg

SEQ ID NO: 978435 - DNA, 25 bp, Mus musculus
ttttccaattggacagatcttgaga

SEQ ID NO: 978436 - DNA, 25 bp, Mus musculus
ttttccaattggtcagatcttgaga

SEQ ID NO: 978437 - DNA, 25 bp, Mus musculus
ttttccacactcacctctggatagt

SEQ ID NO: 978438 - DNA, 25 bp, Mus musculus
ttttccacactctcctctggatagt

SEQ ID NO: 978439 - DNA, 25 bp, Mus musculus
ttttccacacttaagaatttgtata

SEQ ID NO: 978440 - DNA, 25 bp, Mus musculus
ttttccacactttagaatttgtata

SEQ ID NO: 978441 - DNA, 25 bp, Mus musculus
ttttccacatgtcgcgcttctacaa

SEQ ID NO: 978442 - DNA, 25 bp, Mus musculus
ttttccacatgtggcgcttctacaa

SEQ ID NO: 978443 - DNA, 25 bp, Mus musculus
ttttccaccaagagcggatggaggt

SEQ ID NO: 978444 - DNA, 25 bp, Mus musculus
ttttccaccaagtgcggatggaggt

SEQ ID NO: 978445 - DNA, 25 bp, Mus musculus
ttttccaccccaactctagtgtgaa

SEQ ID NO: 978446 - DNA, 25 bp, Mus musculus
ttttccaccccatctctagtgtgaa

SEQ ID NO: 978447 - DNA, 25 bp, Mus musculus
ttttccacccttaacttcgtgatga

SEQ ID NO: 978448 - DNA, 25 bp, Mus musculus
ttttccaccctttacttcgtgatga

SEQ ID NO: 978449 - DNA, 25 bp, Mus musculus
ttttccacctcaaaggtagctgaga

SEQ ID NO: 978450 - DNA, 25 bp, Mus musculus
ttttccacctcataggtagctgaga

SEQ ID NO: 978451 - DNA, 25 bp, Mus musculus
ttttccacctcgctgtaaaaatggt

SEQ ID NO: 978452 - DNA, 25 bp, Mus musculus
ttttccacctcggtgtaaaaatggt

SEQ ID NO: 978453 - DNA, 25 bp, Mus musculus
ttttccacgctgactcatcttaaaa

SEQ ID NO: 978454 - DNA, 25 bp, Mus musculus
ttttccacgctgtctcatcttaaaa

SEQ ID NO: 978455 - DNA, 25 bp, Mus musculus
ttttccacggcgactcagagattga

SEQ ID NO: 978456 - DNA, 25 bp, Mus musculus
ttttccacggcgtctcagagattga

SEQ ID NO: 978457 - DNA, 25 bp, Mus musculus
ttttccacgggaccagcacatgaat

SEQ ID NO: 978458 - DNA, 25 bp, Mus musculus
ttttccacgggagcagcacatgaat

SEQ ID NO: 978459 - DNA, 25 bp, Mus musculus
ttttccacgtggacctggtgagcaa

SEQ ID NO: 978460 - DNA, 25 bp, Mus musculus
ttttccacgtggtcctggtgagcaa

SEQ ID NO: 978461 - DNA, 25 bp, Mus musculus
ttttccactcgacccaaaatattgg

SEQ ID NO: 978462 - DNA, 25 bp, Mus musculus
ttttccactcgagccaaaatattgg

SEQ ID NO: 978463 - DNA, 25 bp, Mus musculus
ttttccactcttccgtatgttgtga

SEQ ID NO: 978464 - DNA, 25 bp, Mus musculus
ttttccactcttgcgtatgttgtga

SEQ ID NO: 978465 - DNA, 25 bp, Mus musculus
ttttccactgaactagcctgtacct

SEQ ID NO: 978466 - DNA, 25 bp, Mus musculus
ttttccactgaagtagcctgtacct

SEQ ID NO: 978467 - DNA, 25 bp, Mus musculus
ttttccactgagctctgggttattc

SEQ ID NO: 978468 - DNA, 25 bp, Mus musculus
ttttccactgaggtctgggttattc

SEQ ID NO: 978469 - DNA, 25 bp, Mus musculus
ttttccactgatctaccaatgtaaa

SEQ ID NO: 978470 - DNA, 25 bp, Mus musculus
ttttccactgatgtaccaatgtaaa

SEQ ID NO: 978471 - DNA, 25 bp, Mus musculus
ttttccactggaacaccttactgta

SEQ ID NO: 978472 - DNA, 25 bp, Mus musculus
ttttccactggatcaccttactgta

SEQ ID NO: 978473 - DNA, 25 bp, Mus musculus
ttttccagaagcatcgcttttaggt

SEQ ID NO: 978474 - DNA, 25 bp, Mus musculus
ttttccagaagcttcgcttttaggt

SEQ ID NO: 978475 - DNA, 25 bp, Mus musculus
ttttccagaataaaaccaaccaagc

SEQ ID NO: 978476 - DNA, 25 bp, Mus musculus
ttttccagaatataaccaaccaagc

SEQ ID NO: 978477 - DNA, 25 bp, Mus musculus
ttttccagacctagactggattgct

SEQ ID NO: 978478 - DNA, 25 bp, Mus musculus
ttttccagaccttgactggattgct

SEQ ID NO: 978479 - DNA, 25 bp, Mus musculus
ttttccagacttccactgaagggct

SEQ ID NO: 978480 - DNA, 25 bp, Mus musculus
ttttccagacttgcactgaagggct

SEQ ID NO: 978481 - DNA, 25 bp, Mus musculus
ttttccagagagatttccgcggtct

SEQ ID NO: 978482 - DNA, 25 bp, Mus musculus
ttttccagagagttttccgcggtct

SEQ ID NO: 978483 - DNA, 25 bp, Mus musculus
ttttccagattacaacagatctcag

SEQ ID NO: 978484 - DNA, 25 bp, Mus musculus
ttttccagattagaacagatctcag

SEQ ID NO: 978485 - DNA, 25 bp, Mus musculus
ttttccagccaaaacatccattcga

SEQ ID NO: 978486 - DNA, 25 bp, Mus musculus
ttttccagccaatacatccattcga

SEQ ID NO: 978487 - DNA, 25 bp, Mus musculus
ttttccagcctgattacaatccatg

SEQ ID NO: 978488 - DNA, 25 bp, Mus musculus
ttttccagcctgtttacaatccatg

SEQ ID NO: 978489 - DNA, 25 bp, Mus musculus
ttttccaggaacacctgagagcttt

SEQ ID NO: 978490 - DNA, 25 bp, Mus musculus
ttttccaggaactcctgagagcttt

SEQ ID NO: 978491 - DNA, 25 bp, Mus musculus
ttttccaggccccagacacagtagc

SEQ ID NO: 978492 - DNA, 25 bp, Mus musculus
ttttccaggcccgagacacagtagc

SEQ ID NO: 978493 - DNA, 25 bp, Mus musculus
ttttccaggcgcatataatcaccac

SEQ ID NO: 978494 - DNA, 25 bp, Mus musculus
ttttccaggcgcttataatcaccac

SEQ ID NO: 978495 - DNA, 25 bp, Mus musculus
ttttccagggctcacagcagggctt

SEQ ID NO: 978496 - DNA, 25 bp, Mus musculus
ttttccagggctgacagcagggctt

SEQ ID NO: 978497 - DNA, 25 bp, Mus musculus
ttttccagtgaaatgctttgatgct

SEQ ID NO: 978498 - DNA, 25 bp, Mus musculus
ttttccagtgaattgctttgatgct

SEQ ID NO: 978499 - DNA, 25 bp, Mus musculus
ttttccagtgataaccagttcacta

SEQ ID NO: 978500 - DNA, 25 bp, Mus musculus
ttttccagtgattaccagttcacta

SEQ ID NO: 978501 - DNA, 25 bp, Mus musculus
ttttccagttatcccactacgagtg

SEQ ID NO: 978502 - DNA, 25 bp, Mus musculus
ttttccagttatgccactacgagtg

SEQ ID NO: 978503 - DNA, 25 bp, Mus musculus
ttttccagttgcacttcatcttaag

SEQ ID NO: 978504 - DNA, 25 bp, Mus musculus
ttttccagttgctcttcatcttaag

SEQ ID NO: 978505 - DNA, 25 bp, Mus musculus
ttttccagttggagcggaagcccac

SEQ ID NO: 978506 - DNA, 25 bp, Mus musculus
ttttccagttggtgcggaagcccac

SEQ ID NO: 978507 - DNA, 25 bp, Mus musculus
ttttccataaacaagttcaggccaa

SEQ ID NO: 978508 - DNA, 25 bp, Mus musculus
ttttccataaactagttcaggccaa

SEQ ID NO: 978509 - DNA, 25 bp, Mus musculus
ttttccataactacaggcctctgca

SEQ ID NO: 978510 - DNA, 25 bp, Mus musculus
ttttccataacttcaggcctctgca

SEQ ID NO: 978511 - DNA, 25 bp, Mus musculus
ttttccatactcaagccaaggctct

SEQ ID NO: 978512 - DNA, 25 bp, Mus musculus
ttttccatactctagccaaggctct

SEQ ID NO: 978513 - DNA, 25 bp, Mus musculus
ttttccatcacaagggcagctgcag

SEQ ID NO: 978514 - DNA, 25 bp, Mus musculus
ttttccatcacatgggcagctgcag

SEQ ID NO: 978515 - DNA, 25 bp, Mus musculus
ttttccatcaccaggcagcaacggg

SEQ ID NO: 978516 - DNA, 25 bp, Mus musculus
ttttccatcacctggcagcaacggg

SEQ ID NO: 978517 - DNA, 25 bp, Mus musculus
ttttccatcattatgaatagcttag

SEQ ID NO: 978518 - DNA, 25 bp, Mus musculus
ttttccatcattttgaatagcttag

SEQ ID NO: 978519 - DNA, 25 bp, Mus musculus
ttttccatctccagctgctaaaatt

SEQ ID NO: 978520 - DNA, 25 bp, Mus musculus
ttttccatctccagtaaactaatca

SEQ ID NO: 978521 - DNA, 25 bp, Mus musculus
ttttccatctcctgctgctaaaatt

SEQ ID NO: 978522 - DNA, 25 bp, Mus musculus
ttttccatctcctgtaaactaatca

SEQ ID NO: 978523 - DNA, 25 bp, Mus musculus
ttttccatctctatcatttttgaag

SEQ ID NO: 978524 - DNA, 25 bp, Mus musculus
ttttccatctctcggtaacatgtcc

SEQ ID NO: 978525 - DNA, 25 bp, Mus musculus
ttttccatctctgggtaacatgtcc

SEQ ID NO: 978526 - DNA, 25 bp, Mus musculus
ttttccatctctttcatttttgaag

SEQ ID NO: 978527 - DNA, 25 bp, Mus musculus
ttttccatcttaatccagcatcggg

SEQ ID NO: 978528 - DNA, 25 bp, Mus musculus
ttttccatcttattccagcatcggg

SEQ ID NO: 978529 - DNA, 25 bp, Mus musculus
ttttccatgcaacccatacggtaat

SEQ ID NO: 978530 - DNA, 25 bp, Mus musculus
ttttccatgcaagccatacggtaat

SEQ ID NO: 978531 - DNA, 25 bp, Mus musculus
ttttccatgcttcgtgccaggagta

SEQ ID NO: 978532 - DNA, 25 bp, Mus musculus
ttttccatgcttggtgccaggagta

SEQ ID NO: 978533 - DNA, 25 bp, Mus musculus
ttttccatggctaacttgcaactca

SEQ ID NO: 978534 - DNA, 25 bp, Mus musculus
ttttccatggcttacttgcaactca

SEQ ID NO: 978535 - DNA, 25 bp, Mus musculus
ttttccatgtctcctagccatttag

SEQ ID NO: 978536 - DNA, 25 bp, Mus musculus
ttttccatgtctgctagccatttag

SEQ ID NO: 978537 - DNA, 25 bp, Mus musculus
ttttccatgtgcatggtttttcctc

SEQ ID NO: 978538 - DNA, 25 bp, Mus musculus
ttttccatgtgcttggtttttcctc

SEQ ID NO: 978539 - DNA, 25 bp, Mus musculus
ttttccattcaaccaaatcttcagg

SEQ ID NO: 978540 - DNA, 25 bp, Mus musculus
ttttccattcaagcaaatcttcagg

SEQ ID NO: 978541 - DNA, 25 bp, Mus musculus
ttttccattctacaccatggtaaaa

SEQ ID NO: 978542 - DNA, 25 bp, Mus musculus
ttttccattctagaccatggtaaaa

SEQ ID NO: 978543 - DNA, 25 bp, Mus musculus
ttttccatttcaacaatagcacaac

SEQ ID NO: 978544 - DNA, 25 bp, Mus musculus
ttttccatttcatcaatagcacaac

SEQ ID NO: 978545 - DNA, 25 bp, Mus musculus
ttttccatttgtacatccaagcgta

SEQ ID NO: 978546 - DNA, 25 bp, Mus musculus
ttttccatttgttcatccaagcgta

SEQ ID NO: 978547 - DNA, 25 bp, Mus musculus
ttttcccaacagacgatcttcagac

SEQ ID NO: 978548 - DNA, 25 bp, Mus musculus
ttttcccaacagtcgatcttcagac

SEQ ID NO: 978549 - DNA, 25 bp, Mus musculus
ttttcccaaccacgctgaaaggcag

SEQ ID NO: 978550 - DNA, 25 bp, Mus musculus
ttttcccaaccacttagaaatgcaa

SEQ ID NO: 978551 - DNA, 25 bp, Mus musculus
ttttcccaaccaggctgaaaggcag

SEQ ID NO: 978552 - DNA, 25 bp, Mus musculus
ttttcccaaccagttagaaatgcaa

SEQ ID NO: 978553 - DNA, 25 bp, Mus musculus
ttttcccaagaaatctttctgcttt

SEQ ID NO: 978554 - DNA, 25 bp, Mus musculus
ttttcccaagaattctttctgcttt

SEQ ID NO: 978555 - DNA, 25 bp, Mus musculus
ttttcccaagagagggctgcagcat

SEQ ID NO: 978556 - DNA, 25 bp, Mus musculus
ttttcccaagagtgggctgcagcat

SEQ ID NO: 978557 - DNA, 25 bp, Mus musculus
ttttcccaatcactcagttcacaga

SEQ ID NO: 978558 - DNA, 25 bp, Mus musculus
ttttcccaatcagtcagttcacaga

SEQ ID NO: 978559 - DNA, 25 bp, Mus musculus
ttttcccaccttatgaccattgtga

SEQ ID NO: 978560 - DNA, 25 bp, Mus musculus
ttttcccaccttttgaccattgtga

SEQ ID NO: 978561 - DNA, 25 bp, Mus musculus
ttttcccacttcagcttgtttgttt

SEQ ID NO: 978562 - DNA, 25 bp, Mus musculus
ttttcccacttctgcttgtttgttt

SEQ ID NO: 978563 - DNA, 25 bp, Mus musculus
ttttcccacttgcattatgttgatg

SEQ ID NO: 978564 - DNA, 25 bp, Mus musculus
ttttcccacttggattatgttgatg

SEQ ID NO: 978565 - DNA, 25 bp, Mus musculus
ttttcccactttagaggttgaatat

SEQ ID NO: 978566 - DNA, 25 bp, Mus musculus
ttttcccacttttgaggttgaatat

SEQ ID NO: 978567 - DNA, 25 bp, Mus musculus
ttttcccagaatcagaggcagtaag

SEQ ID NO: 978568 - DNA, 25 bp, Mus musculus
ttttcccagaatgagaggcagtaag

SEQ ID NO: 978569 - DNA, 25 bp, Mus musculus
ttttcccagcagatcgcgctacatc

SEQ ID NO: 978570 - DNA, 25 bp, Mus musculus
ttttcccagcagcatcagtgtttac

SEQ ID NO: 978571 - DNA, 25 bp, Mus musculus
ttttcccagcaggatcagtgtttac

SEQ ID NO: 978572 - DNA, 25 bp, Mus musculus
ttttcccagcagttcgcgctacatc

SEQ ID NO: 978573 - DNA, 25 bp, Mus musculus
ttttcccagcataataatctacaaa

SEQ ID NO: 978574 - DNA, 25 bp, Mus musculus
ttttcccagcatcggcactcataaa

SEQ ID NO: 978575 - DNA, 25 bp, Mus musculus
ttttcccagcatgggcactcataaa

SEQ ID NO: 978576 - DNA, 25 bp, Mus musculus
ttttcccagcattataatctacaaa

SEQ ID NO: 978577 - DNA, 25 bp, Mus musculus
ttttcccagctccatggtgaggaca

SEQ ID NO: 978578 - DNA, 25 bp, Mus musculus
ttttcccagctcgatggtgaggaca

SEQ ID NO: 978579 - DNA, 25 bp, Mus musculus
ttttcccagcttacttgttaggttg

SEQ ID NO: 978580 - DNA, 25 bp, Mus musculus
ttttcccagcttctgagcctggtgg

SEQ ID NO: 978581 - DNA, 25 bp, Mus musculus
ttttcccagcttgtgagcctggtgg

SEQ ID NO: 978582 - DNA, 25 bp, Mus musculus
ttttcccagctttcttgttaggttg

SEQ ID NO: 978583 - DNA, 25 bp, Mus musculus
ttttcccaggaaccattgcatgtat

SEQ ID NO: 978584 - DNA, 25 bp, Mus musculus
ttttcccaggaagcattgcatgtat

SEQ ID NO: 978585 - DNA, 25 bp, Mus musculus
ttttcccaggatcaaacctagaaat

SEQ ID NO: 978586 - DNA, 25 bp, Mus musculus
ttttcccaggatgaaacctagaaat

SEQ ID NO: 978587 - DNA, 25 bp, Mus musculus
ttttcccaggcaattctgtaccttt

SEQ ID NO: 978588 - DNA, 25 bp, Mus musculus
ttttcccaggcatttctgtaccttt

SEQ ID NO: 978589 - DNA, 25 bp, Mus musculus
ttttcccagggcaggctactgaatg

SEQ ID NO: 978590 - DNA, 25 bp, Mus musculus
ttttcccagggctggctactgaatg

SEQ ID NO: 978591 - DNA, 25 bp, Mus musculus
ttttcccaggtaatcagcatcgggt

SEQ ID NO: 978592 - DNA, 25 bp, Mus musculus
ttttcccaggtattcagcatcgggt

SEQ ID NO: 978593 - DNA, 25 bp, Mus musculus
ttttcccaggtcctttgtctgaaca

SEQ ID NO: 978594 - DNA, 25 bp, Mus musculus
ttttcccaggtcgtttgtctgaaca

SEQ ID NO: 978595 - DNA, 25 bp, Mus musculus
ttttcccaggttatgtgagaactag

SEQ ID NO: 978596 - DNA, 25 bp, Mus musculus
ttttcccaggttttgtgagaactag

SEQ ID NO: 978597 - DNA, 25 bp, Mus musculus
ttttcccagttcatttcacattttg

SEQ ID NO: 978598 - DNA, 25 bp, Mus musculus
ttttcccagttcttttcacattttg

SEQ ID NO: 978599 - DNA, 25 bp, Mus musculus
ttttcccatatcaagtgaccgagcg

SEQ ID NO: 978600 - DNA, 25 bp, Mus musculus
ttttcccatatcatctccctaagaa

SEQ ID NO: 978601 - DNA, 25 bp, Mus musculus
ttttcccatatctagtgaccgagcg

SEQ ID NO: 978602 - DNA, 25 bp, Mus musculus
ttttcccatatcttctccctaagaa

SEQ ID NO: 978603 - DNA, 25 bp, Mus musculus
ttttcccatcagactgacagcagtg

SEQ ID NO: 978604 - DNA, 25 bp, Mus musculus
ttttcccatcagattgaggaggagc

SEQ ID NO: 978605 - DNA, 25 bp, Mus musculus
ttttcccatcagcaagtcactgtac

SEQ ID NO: 978606 - DNA, 25 bp, Mus musculus
ttttcccatcaggaagtcactgtac

SEQ ID NO: 978607 - DNA, 25 bp, Mus musculus
ttttcccatcagtctgacagcagtg

SEQ ID NO: 978608 - DNA, 25 bp, Mus musculus
ttttcccatcagtttgaggaggagc

SEQ ID NO: 978609 - DNA, 25 bp, Mus musculus
ttttcccatggtattctcagattag

SEQ ID NO: 978610 - DNA, 25 bp, Mus musculus
ttttcccatggttttctcagattag

SEQ ID NO: 978611 - DNA, 25 bp, Mus musculus
ttttcccattgcaacttccatgtga

SEQ ID NO: 978612 - DNA, 25 bp, Mus musculus
ttttcccattgctacttccatgtga

SEQ ID NO: 978613 - DNA, 25 bp, Mus musculus
ttttcccatttgagcgccatgtggt

SEQ ID NO: 978614 - DNA, 25 bp, Mus musculus
ttttcccatttgtgcgccatgtggt

SEQ ID NO: 978615 - DNA, 25 bp, Mus musculus
ttttcccattttccaactttgtgat

SEQ ID NO: 978616 - DNA, 25 bp, Mus musculus
ttttcccattttgcaactttgtgat

SEQ ID NO: 978617 - DNA, 25 bp, Mus musculus
ttttccccaaaccaccaagagcaga

SEQ ID NO: 978618 - DNA, 25 bp, Mus musculus
ttttccccaaacgaccaagagcaga

SEQ ID NO: 978619 - DNA, 25 bp, Mus musculus
ttttccccaacaatcgccatcaggg

SEQ ID NO: 978620 - DNA, 25 bp, Mus musculus
ttttccccaacattcgccatcaggg

SEQ ID NO: 978621 - DNA, 25 bp, Mus musculus
ttttccccacatatttctcctttca

SEQ ID NO: 978622 - DNA, 25 bp, Mus musculus
ttttccccacatttttctcctttca

SEQ ID NO: 978623 - DNA, 25 bp, Mus musculus
ttttccccagaaaagagtcccaatt

SEQ ID NO: 978624 - DNA, 25 bp, Mus musculus
ttttccccagaacttttagcagtag

SEQ ID NO: 978625 - DNA, 25 bp, Mus musculus
ttttccccagaagttttagcagtag

SEQ ID NO: 978626 - DNA, 25 bp, Mus musculus
ttttccccagaatagagtcccaatt

SEQ ID NO: 978627 - DNA, 25 bp, Mus musculus
ttttccccagcgactataaactgct

SEQ ID NO: 978628 - DNA, 25 bp, Mus musculus
ttttccccagcgtctataaactgct

SEQ ID NO: 978629 - DNA, 25 bp, Mus musculus
ttttccccagctcacaaaggttaga

SEQ ID NO: 978630 - DNA, 25 bp, Mus musculus
ttttccccagctgacaaaggttaga

SEQ ID NO: 978631 - DNA, 25 bp, Mus musculus
ttttccccaggacttgagagataga

SEQ ID NO: 978632 - DNA, 25 bp, Mus musculus
ttttccccaggagttgagagataga

SEQ ID NO: 978633 - DNA, 25 bp, Mus musculus
ttttccccatagagacaccaggtga

SEQ ID NO: 978634 - DNA, 25 bp, Mus musculus
ttttccccatagtgacaccaggtga

SEQ ID NO: 978635 - DNA, 25 bp, Mus musculus
ttttccccatcacctaaactacagg

SEQ ID NO: 978636 - DNA, 25 bp, Mus musculus
ttttccccatcagctaaactacagg

SEQ ID NO: 978637 - DNA, 25 bp, Mus musculus
ttttccccatgtatagccaactttc

SEQ ID NO: 978638 - DNA, 25 bp, Mus musculus
ttttccccatgtttagccaactttc

SEQ ID NO: 978639 - DNA, 25 bp, Mus musculus
ttttccccatttaatgagtgagtga

SEQ ID NO: 978640 - DNA, 25 bp, Mus musculus
ttttccccattttatgagtgagtga

SEQ ID NO: 978641 - DNA, 25 bp, Mus musculus
ttttccccgggcacactgctgacgg

SEQ ID NO: 978642 - DNA, 25 bp, Mus musculus
ttttccccgggctcactgctgacgg

SEQ ID NO: 978643 - DNA, 25 bp, Mus musculus
ttttcccctaatctagcaaaagaat

SEQ ID NO: 978644 - DNA, 25 bp, Mus musculus
ttttcccctaatgtagcaaaagaat

SEQ ID NO: 978645 - DNA, 25 bp, Mus musculus
ttttcccctagtaatgggccttatg

SEQ ID NO: 978646 - DNA, 25 bp, Mus musculus
ttttcccctagttatgggccttatg

SEQ ID NO: 978647 - DNA, 25 bp, Mus musculus
ttttcccctcctcttgagatcaaca

SEQ ID NO: 978648 - DNA, 25 bp, Mus musculus
ttttcccctcctgttgagatcaaca

SEQ ID NO: 978649 - DNA, 25 bp, Mus musculus
ttttcccctcttcgctgtattgaaa

SEQ ID NO: 978650 - DNA, 25 bp, Mus musculus
ttttcccctcttggctgtattgaaa

SEQ ID NO: 978651 - DNA, 25 bp, Mus musculus
ttttcccctggacctgattaggaag

SEQ ID NO: 978652 - DNA, 25 bp, Mus musculus
ttttcccctggagctgattaggaag

SEQ ID NO: 978653 - DNA, 25 bp, Mus musculus
ttttcccctgtgcgccaagtagata

SEQ ID NO: 978654 - DNA, 25 bp, Mus musculus
ttttcccctgtgggccaagtagata

SEQ ID NO: 978655 - DNA, 25 bp, Mus musculus
ttttccccttcgaggtcataccaag

SEQ ID NO: 978656 - DNA, 25 bp, Mus musculus
ttttccccttcgtggtcataccaag

SEQ ID NO: 978657 - DNA, 25 bp, Mus musculus
ttttccccttgtcctatgtgcaaaa

SEQ ID NO: 978658 - DNA, 25 bp, Mus musculus
ttttccccttgtgctatgtgcaaaa

SEQ ID NO: 978659 - DNA, 25 bp, Mus musculus
ttttcccctttacgcatactttgca

SEQ ID NO: 978660 - DNA, 25 bp, Mus musculus
ttttcccctttaggcatactttgca

SEQ ID NO: 978661 - DNA, 25 bp, Mus musculus
ttttcccgcagaagtacttagaact

SEQ ID NO: 978662 - DNA, 25 bp, Mus musculus
ttttcccgcagatgtacttagaact

SEQ ID NO: 978663 - DNA, 25 bp, Mus musculus
ttttcccgcggtcccaggaaaggtg

SEQ ID NO: 978664 - DNA, 25 bp, Mus musculus
ttttcccgcggtgccaggaaaggtg

SEQ ID NO: 978665 - DNA, 25 bp, Mus musculus
ttttcccgctcactaatcgatgtca

SEQ ID NO: 978666 - DNA, 25 bp, Mus musculus
ttttcccgctcagtaatcgatgtca

SEQ ID NO: 978667 - DNA, 25 bp, Mus musculus
ttttcccgctcgcaggtgctggagc

SEQ ID NO: 978668 - DNA, 25 bp, Mus musculus
ttttcccgctcggaggtgctggagc

SEQ ID NO: 978669 - DNA, 25 bp, Mus musculus
ttttcccgggctcactcatctgcat

SEQ ID NO: 978670 - DNA, 25 bp, Mus musculus
ttttcccgggctgactcatctgcat

SEQ ID NO: 978671 - DNA, 25 bp, Mus musculus
ttttcccgtcggacctgcacaaaca

SEQ ID NO: 978672 - DNA, 25 bp, Mus musculus
ttttcccgtcggtcctgcacaaaca

SEQ ID NO: 978673 - DNA, 25 bp, Mus musculus
ttttcccgttccagatcccgagata

SEQ ID NO: 978674 - DNA, 25 bp, Mus musculus
ttttcccgttcctgatcccgagata

SEQ ID NO: 978675 - DNA, 25 bp, Mus musculus
ttttccctacaactcaaacttcaga

SEQ ID NO: 978676 - DNA, 25 bp, Mus musculus
ttttccctacaagtcaaacttcaga

SEQ ID NO: 978677 - DNA, 25 bp, Mus musculus
ttttccctacctaagcattccatgg

SEQ ID NO: 978678 - DNA, 25 bp, Mus musculus
ttttccctaccttagcattccatgg

SEQ ID NO: 978679 - DNA, 25 bp, Mus musculus
ttttccctactcctggtttggtcag

SEQ ID NO: 978680 - DNA, 25 bp, Mus musculus
ttttccctactcgtggtttggtcag

SEQ ID NO: 978681 - DNA, 25 bp, Mus musculus
ttttccctactgactcacaagaggc

SEQ ID NO: 978682 - DNA, 25 bp, Mus musculus
ttttccctactgtctcacaagaggc

SEQ ID NO: 978683 - DNA, 25 bp, Mus musculus
ttttccctagatagtaactggcttt

SEQ ID NO: 978684 - DNA, 25 bp, Mus musculus
ttttccctagattgtaactggcttt

SEQ ID NO: 978685 - DNA, 25 bp, Mus musculus
ttttccctaggccttatagtataga

SEQ ID NO: 978686 - DNA, 25 bp, Mus musculus
ttttccctaggcgttatagtataga

SEQ ID NO: 978687 - DNA, 25 bp, Mus musculus
ttttccctcaagatagcacaagata

SEQ ID NO: 978688 - DNA, 25 bp, Mus musculus
ttttccctcaagttagcacaagata

SEQ ID NO: 978689 - DNA, 25 bp, Mus musculus
ttttccctcagccagtctatggtgt

SEQ ID NO: 978690 - DNA, 25 bp, Mus musculus
ttttccctcagcgagtctatggtgt

SEQ ID NO: 978691 - DNA, 25 bp, Mus musculus
ttttccctcatcagttactgtttca

SEQ ID NO: 978692 - DNA, 25 bp, Mus musculus
ttttccctcatctgttactgtttca

SEQ ID NO: 978693 - DNA, 25 bp, Mus musculus
ttttccctctccagtcggtggtctc

SEQ ID NO: 978694 - DNA, 25 bp, Mus musculus
ttttccctctcctgtcggtggtctc

SEQ ID NO: 978695 - DNA, 25 bp, Mus musculus
ttttccctctctcgtgataaggttt

SEQ ID NO: 978696 - DNA, 25 bp, Mus musculus
ttttccctctctggtgataaggttt

SEQ ID NO: 978697 - DNA, 25 bp, Mus musculus
ttttccctgagaaacctgtcgtgaa

SEQ ID NO: 978698 - DNA, 25 bp, Mus musculus
ttttccctgagatacctgtcgtgaa

SEQ ID NO: 978699 - DNA, 25 bp, Mus musculus
ttttccctgagtagggttgacctca

SEQ ID NO: 978700 - DNA, 25 bp, Mus musculus
ttttccctgagttgggttgacctca

SEQ ID NO: 978701 - DNA, 25 bp, Mus musculus
ttttccctgatgaccgtcctgacaa

SEQ ID NO: 978702 - DNA, 25 bp, Mus musculus
ttttccctgatgtccgtcctgacaa

SEQ ID NO: 978703 - DNA, 25 bp, Mus musculus
ttttccctgctaacagtttctggaa

SEQ ID NO: 978704 - DNA, 25 bp, Mus musculus
ttttccctgctatcagtttctggaa

SEQ ID NO: 978705 - DNA, 25 bp, Mus musculus
ttttccctgctgcaattttagcatt

SEQ ID NO: 978706 - DNA, 25 bp, Mus musculus
ttttccctgctggaattttagcatt

SEQ ID NO: 978707 - DNA, 25 bp, Mus musculus
ttttccctgggaagtatctctttca

SEQ ID NO: 978708 - DNA, 25 bp, Mus musculus
ttttccctgggatgtatctctttca

SEQ ID NO: 978709 - DNA, 25 bp, Mus musculus
ttttccctggtcacttagcacttaa

SEQ ID NO: 978710 - DNA, 25 bp, Mus musculus
ttttccctggtctcttagcacttaa

SEQ ID NO: 978711 - DNA, 25 bp, Mus musculus
ttttccctggtgagccgtgacccat

SEQ ID NO: 978712 - DNA, 25 bp, Mus musculus
ttttccctggtgtgccgtgacccat

SEQ ID NO: 978713 - DNA, 25 bp, Mus musculus
ttttccctggttcctctatgtgaac

SEQ ID NO: 978714 - DNA, 25 bp, Mus musculus
ttttccctggttgctctatgtgaac

SEQ ID NO: 978715 - DNA, 25 bp, Mus musculus
ttttccctgtcaacagagggcgagg

SEQ ID NO: 978716 - DNA, 25 bp, Mus musculus
ttttccctgtcatcagagggcgagg

SEQ ID NO: 978717 - DNA, 25 bp, Mus musculus
ttttcccttacccatgactgtggct

SEQ ID NO: 978718 - DNA, 25 bp, Mus musculus
ttttcccttaccgatgactgtggct

SEQ ID NO: 978719 - DNA, 25 bp, Mus musculus
ttttcccttatgctttggctttcat

SEQ ID NO: 978720 - DNA, 25 bp, Mus musculus
ttttcccttatggtttggctttcat

SEQ ID NO: 978721 - DNA, 25 bp, Mus musculus
ttttcccttcccatgcagattgtga

SEQ ID NO: 978722 - DNA, 25 bp, Mus musculus
ttttcccttcccttgcagattgtga

SEQ ID NO: 978723 - DNA, 25 bp, Mus musculus
ttttcccttcctcccagagtatgct

SEQ ID NO: 978724 - DNA, 25 bp, Mus musculus
ttttcccttcctgccagagtatgct

SEQ ID NO: 978725 - DNA, 25 bp, Mus musculus
ttttcccttcggagaaagcaggacg

SEQ ID NO: 978726 - DNA, 25 bp, Mus musculus
ttttcccttcggtgaaagcaggacg

SEQ ID NO: 978727 - DNA, 25 bp, Mus musculus
ttttcccttctaatgcctgttgcta

SEQ ID NO: 978728 - DNA, 25 bp, Mus musculus
ttttcccttctattgcctgttgcta

SEQ ID NO: 978729 - DNA, 25 bp, Mus musculus
ttttcccttctgcaggatgtttgca

SEQ ID NO: 978730 - DNA, 25 bp, Mus musculus
ttttcccttctggaggatgtttgca

SEQ ID NO: 978731 - DNA, 25 bp, Mus musculus
ttttcccttcttctgtcgaatcaga

SEQ ID NO: 978732 - DNA, 25 bp, Mus musculus
ttttcccttcttgtgtcgaatcaga

SEQ ID NO: 978733 - DNA, 25 bp, Mus musculus
ttttcccttgcaatgtgacttttag

SEQ ID NO: 978734 - DNA, 25 bp, Mus musculus
ttttcccttgcacagggttgacata

SEQ ID NO: 978735 - DNA, 25 bp, Mus musculus
ttttcccttgcagagggttgacata

SEQ ID NO: 978736 - DNA, 25 bp, Mus musculus
ttttcccttgcattgtgacttttag

SEQ ID NO: 978737 - DNA, 25 bp, Mus musculus
ttttcccttggtagcttatggagca

SEQ ID NO: 978738 - DNA, 25 bp, Mus musculus
ttttcccttggttgcttatggagca

SEQ ID NO: 978739 - DNA, 25 bp, Mus musculus
ttttccctttataacctgtgcacat

SEQ ID NO: 978740 - DNA, 25 bp, Mus musculus
ttttccctttattacctgtgcacat

SEQ ID NO: 978741 - DNA, 25 bp, Mus musculus
ttttccctttctcacctgagacaaa

SEQ ID NO: 978742 - DNA, 25 bp, Mus musculus
ttttccctttctctagagactgttt

SEQ ID NO: 978743 - DNA, 25 bp, Mus musculus
ttttccctttctgacctgagacaaa

SEQ ID NO: 978744 - DNA, 25 bp, Mus musculus
ttttccctttctgtagagactgttt

SEQ ID NO: 978745 - DNA, 25 bp, Mus musculus
ttttccgaagaaaacaggatccctt

SEQ ID NO: 978746 - DNA, 25 bp, Mus musculus
ttttccgaagaatacaggatccctt

SEQ ID NO: 978747 - DNA, 25 bp, Mus musculus
ttttccgaggcaccacatctggctt

SEQ ID NO: 978748 - DNA, 25 bp, Mus musculus
ttttccgaggcagcacatctggctt

SEQ ID NO: 978749 - DNA, 25 bp, Mus musculus
ttttccgagggccagacgtgacatg

SEQ ID NO: 978750 - DNA, 25 bp, Mus musculus
ttttccgagggcgagacgtgacatg

SEQ ID NO: 978751 - DNA, 25 bp, Mus musculus
ttttccgcactgacttgctaatgtt

SEQ ID NO: 978752 - DNA, 25 bp, Mus musculus
ttttccgcactgtcttgctaatgtt

SEQ ID NO: 978753 - DNA, 25 bp, Mus musculus
ttttccgcagacacagcaggctgat

SEQ ID NO: 978754 - DNA, 25 bp, Mus musculus
ttttccgcagactcagcaggctgat

SEQ ID NO: 978755 - DNA, 25 bp, Mus musculus
ttttccgcctgcagggatcagacag

SEQ ID NO: 978756 - DNA, 25 bp, Mus musculus
ttttccgcctgctgggatcagacag

SEQ ID NO: 978757 - DNA, 25 bp, Mus musculus
ttttccgcgggccatggtgtctgct

SEQ ID NO: 978758 - DNA, 25 bp, Mus musculus
ttttccgcgggcgatggtgtctgct

SEQ ID NO: 978759 - DNA, 25 bp, Mus musculus
ttttccgctctcaaatttggtggca

SEQ ID NO: 978760 - DNA, 25 bp, Mus musculus
ttttccgctctctaatttggtggca

SEQ ID NO: 978761 - DNA, 25 bp, Mus musculus
ttttccggaaagcattgggctgcca

SEQ ID NO: 978762 - DNA, 25 bp, Mus musculus
ttttccggaaaggattgggctgcca

SEQ ID NO: 978763 - DNA, 25 bp, Mus musculus
ttttccggcacaaagactctcgagg

SEQ ID NO: 978764 - DNA, 25 bp, Mus musculus
ttttccggcacatagactctcgagg

SEQ ID NO: 978765 - DNA, 25 bp, Mus musculus
ttttccgtatcaacccaggcattgg

SEQ ID NO: 978766 - DNA, 25 bp, Mus musculus
ttttccgtatcatcccaggcattgg

SEQ ID NO: 978767 - DNA, 25 bp, Mus musculus
ttttccgtctgtcgcccgaaagcct

SEQ ID NO: 978768 - DNA, 25 bp, Mus musculus
ttttccgtctgtggcccgaaagcct

SEQ ID NO: 978769 - DNA, 25 bp, Mus musculus
ttttccgttcccctcagccaagtgc

SEQ ID NO: 978770 - DNA, 25 bp, Mus musculus
ttttccgttcccgtcagccaagtgc

SEQ ID NO: 978771 - DNA, 25 bp, Mus musculus
ttttccgtttcgagcattaaagtga

SEQ ID NO: 978772 - DNA, 25 bp, Mus musculus
ttttccgtttcgtgcattaaagtga

SEQ ID NO: 978773 - DNA, 25 bp, Mus musculus
ttttcctaaccgctctccagctcca

SEQ ID NO: 978774 - DNA, 25 bp, Mus musculus
ttttcctaaccggtctccagctcca

SEQ ID NO: 978775 - DNA, 25 bp, Mus musculus
ttttcctaacggactgaattccagc

SEQ ID NO: 978776 - DNA, 25 bp, Mus musculus
ttttcctaacggtctgaattccagc

SEQ ID NO: 978777 - DNA, 25 bp, Mus musculus
ttttcctaagtacttctcaagttag

SEQ ID NO: 978778 - DNA, 25 bp, Mus musculus
ttttcctaagtagttctcaagttag

SEQ ID NO: 978779 - DNA, 25 bp, Mus musculus
ttttcctactccctcagattatgta

SEQ ID NO: 978780 - DNA, 25 bp, Mus musculus
ttttcctactccgtcagattatgta

SEQ ID NO: 978781 - DNA, 25 bp, Mus musculus
ttttcctacttaaccccaggatctg

SEQ ID NO: 978782 - DNA, 25 bp, Mus musculus
ttttcctacttatccccaggatctg

SEQ ID NO: 978783 - DNA, 25 bp, Mus musculus
ttttcctagctaatctagcctaagc

SEQ ID NO: 978784 - DNA, 25 bp, Mus musculus
ttttcctagctattctagcctaagc

SEQ ID NO: 978785 - DNA, 25 bp, Mus musculus
ttttcctaggcaattcgtggtcaaa

SEQ ID NO: 978786 - DNA, 25 bp, Mus musculus
ttttcctaggcatttcgtggtcaaa

SEQ ID NO: 978787 - DNA, 25 bp, Mus musculus
ttttcctagtccctgaaacctgtct

SEQ ID NO: 978788 - DNA, 25 bp, Mus musculus
ttttcctagtccgtgaaacctgtct

SEQ ID NO: 978789 - DNA, 25 bp, Mus musculus
ttttcctagtgtacccctggccata

SEQ ID NO: 978790 - DNA, 25 bp, Mus musculus
ttttcctagtgttcccctggccata

SEQ ID NO: 978791 - DNA, 25 bp, Mus musculus
ttttcctagttcatcctaatgccaa

SEQ ID NO: 978792 - DNA, 25 bp, Mus musculus
ttttcctagttcttcctaatgccaa

SEQ ID NO: 978793 - DNA, 25 bp, Mus musculus
ttttcctataacagtccccttatca

SEQ ID NO: 978794 - DNA, 25 bp, Mus musculus
ttttcctataactgtccccttatca

SEQ ID NO: 978795 - DNA, 25 bp, Mus musculus
ttttcctatatcacacagtattaaa

SEQ ID NO: 978796 - DNA, 25 bp, Mus musculus
ttttcctatatctcacagtattaaa

SEQ ID NO: 978797 - DNA, 25 bp, Mus musculus
ttttcctatatgatagggccagtgg

SEQ ID NO: 978798 - DNA, 25 bp, Mus musculus
ttttcctatatgttagggccagtgg

SEQ ID NO: 978799 - DNA, 25 bp, Mus musculus
ttttcctatcaacgcaggtactcct

SEQ ID NO: 978800 - DNA, 25 bp, Mus musculus
ttttcctatcaaggcaggtactcct

SEQ ID NO: 978801 - DNA, 25 bp, Mus musculus
ttttcctatcatcactggctgggcc

SEQ ID NO: 978802 - DNA, 25 bp, Mus musculus
ttttcctatcatgactggctgggcc

SEQ ID NO: 978803 - DNA, 25 bp, Mus musculus
ttttcctatggaattgtttctatta

SEQ ID NO: 978804 - DNA, 25 bp, Mus musculus
ttttcctatggatttgtttctatta

SEQ ID NO: 978805 - DNA, 25 bp, Mus musculus
ttttcctcaaagatctccaggcagg

SEQ ID NO: 978806 - DNA, 25 bp, Mus musculus
ttttcctcaaagttctccaggcagg

SEQ ID NO: 978807 - DNA, 25 bp, Mus musculus
ttttcctcaagcaactgtctttctt

SEQ ID NO: 978808 - DNA, 25 bp, Mus musculus
ttttcctcaagctactgtctttctt

SEQ ID NO: 978809 - DNA, 25 bp, Mus musculus
ttttcctcaagtcatttggcaacaa

SEQ ID NO: 978810 - DNA, 25 bp, Mus musculus
ttttcctcaagtgatttggcaacaa

SEQ ID NO: 978811 - DNA, 25 bp, Mus musculus
ttttcctcagaaaatttcgttgact

SEQ ID NO: 978812 - DNA, 25 bp, Mus musculus
ttttcctcagaatatttcgttgact

SEQ ID NO: 978813 - DNA, 25 bp, Mus musculus
ttttcctcagcaattgctgagccag

SEQ ID NO: 978814 - DNA, 25 bp, Mus musculus
ttttcctcagcatttgctgagccag

SEQ ID NO: 978815 - DNA, 25 bp, Mus musculus
ttttcctccaagcaacaaatgaccc

SEQ ID NO: 978816 - DNA, 25 bp, Mus musculus
ttttcctccaaggaacaaatgaccc

SEQ ID NO: 978817 - DNA, 25 bp, Mus musculus
ttttcctccacaagcacatgtggtc

SEQ ID NO: 978818 - DNA, 25 bp, Mus musculus
ttttcctccacatgcacatgtggtc

SEQ ID NO: 978819 - DNA, 25 bp, Mus musculus
ttttcctccagtctacagcagaagg

SEQ ID NO: 978820 - DNA, 25 bp, Mus musculus
ttttcctccagtgtacagcagaagg

SEQ ID NO: 978821 - DNA, 25 bp, Mus musculus
ttttcctcccacaatagagttttgt

SEQ ID NO: 978822 - DNA, 25 bp, Mus musculus
ttttcctcccactatagagttttgt

SEQ ID NO: 978823 - DNA, 25 bp, Mus musculus
ttttcctccgcaatgtcaagtcttt

SEQ ID NO: 978824 - DNA, 25 bp, Mus musculus
ttttcctccgcattgtcaagtcttt

SEQ ID NO: 978825 - DNA, 25 bp, Mus musculus
ttttcctcctcactttgcttataat

SEQ ID NO: 978826 - DNA, 25 bp, Mus musculus
ttttcctcctcagtttgcttataat

SEQ ID NO: 978827 - DNA, 25 bp, Mus musculus
ttttcctcctgtatcgctaagtgta

SEQ ID NO: 978828 - DNA, 25 bp, Mus musculus
ttttcctcctgtcttcttctacatg

SEQ ID NO: 978829 - DNA, 25 bp, Mus musculus
ttttcctcctgtgttcttctacatg

SEQ ID NO: 978830 - DNA, 25 bp, Mus musculus
ttttcctcctgtttcgctaagtgta

SEQ ID NO: 978831 - DNA, 25 bp, Mus musculus
ttttcctcggctatacatatacctc

SEQ ID NO: 978832 - DNA, 25 bp, Mus musculus
ttttcctcggctttacatatacctc

SEQ ID NO: 978833 - DNA, 25 bp, Mus musculus
ttttcctctagaccacacttaatgc

SEQ ID NO: 978834 - DNA, 25 bp, Mus musculus
ttttcctctagagcacacttaatgc

SEQ ID NO: 978835 - DNA, 25 bp, Mus musculus
ttttcctctagcaaactctctatca

SEQ ID NO: 978836 - DNA, 25 bp, Mus musculus
ttttcctctagctaactctctatca

SEQ ID NO: 978837 - DNA, 25 bp, Mus musculus
ttttcctctcacagcagactaacat

SEQ ID NO: 978838 - DNA, 25 bp, Mus musculus
ttttcctctcactgcagactaacat

SEQ ID NO: 978839 - DNA, 25 bp, Mus musculus
ttttcctctccaacaagtacaattc

SEQ ID NO: 978840 - DNA, 25 bp, Mus musculus
ttttcctctccactctgacaacagg

SEQ ID NO: 978841 - DNA, 25 bp, Mus musculus
ttttcctctccagtctgacaacagg

SEQ ID NO: 978842 - DNA, 25 bp, Mus musculus
ttttcctctccatcaagtacaattc

SEQ ID NO: 978843 - DNA, 25 bp, Mus musculus
ttttcctctcgtagctcttattcat

SEQ ID NO: 978844 - DNA, 25 bp, Mus musculus
ttttcctctcgttgctcttattcat

SEQ ID NO: 978845 - DNA, 25 bp, Mus musculus
ttttcctctcttatcattatgcact

SEQ ID NO: 978846 - DNA, 25 bp, Mus musculus
ttttcctctcttttcattatgcact

SEQ ID NO: 978847 - DNA, 25 bp, Mus musculus
ttttcctctgagactgtcctcaaaa

SEQ ID NO: 978848 - DNA, 25 bp, Mus musculus
ttttcctctgagtctgtcctcaaaa

SEQ ID NO: 978849 - DNA, 25 bp, Mus musculus
ttttcctctgcacggatttgcgtct

SEQ ID NO: 978850 - DNA, 25 bp, Mus musculus
ttttcctctgcagggatttgcgtct

SEQ ID NO: 978851 - DNA, 25 bp, Mus musculus
ttttcctctgccatagacagataga

SEQ ID NO: 978852 - DNA, 25 bp, Mus musculus
ttttcctctgccttagacagataga

SEQ ID NO: 978853 - DNA, 25 bp, Mus musculus
ttttcctcttaccacattatcccaa

SEQ ID NO: 978854 - DNA, 25 bp, Mus musculus
ttttcctcttacctttacgaagctg

SEQ ID NO: 978855 - DNA, 25 bp, Mus musculus
ttttcctcttacgacattatcccaa

SEQ ID NO: 978856 - DNA, 25 bp, Mus musculus
ttttcctcttacgtttacgaagctg

SEQ ID NO: 978857 - DNA, 25 bp, Mus musculus
ttttcctcttccactttgagcttgg

SEQ ID NO: 978858 - DNA, 25 bp, Mus musculus
ttttcctcttcccagttgtattgtc

SEQ ID NO: 978859 - DNA, 25 bp, Mus musculus
ttttcctcttccgagttgtattgtc

SEQ ID NO: 978860 - DNA, 25 bp, Mus musculus
ttttcctcttcctctttgagcttgg

SEQ ID NO: 978861 - DNA, 25 bp, Mus musculus
ttttcctcttgccatgtgacccatg

SEQ ID NO: 978862 - DNA, 25 bp, Mus musculus
ttttcctcttgcgatgtgacccatg

SEQ ID NO: 978863 - DNA, 25 bp, Mus musculus
ttttcctctttcaaatcagtgttct

SEQ ID NO: 978864 - DNA, 25 bp, Mus musculus
ttttcctctttctaatcagtgttct

SEQ ID NO: 978865 - DNA, 25 bp, Mus musculus
ttttcctgaagcacggctcagaact

SEQ ID NO: 978866 - DNA, 25 bp, Mus musculus
ttttcctgaagctcggctcagaact

SEQ ID NO: 978867 - DNA, 25 bp, Mus musculus
ttttcctgaaggagctatttaacaa

SEQ ID NO: 978868 - DNA, 25 bp, Mus musculus
ttttcctgaaggtgctatttaacaa

SEQ ID NO: 978869 - DNA, 25 bp, Mus musculus
ttttcctgagctatccagttgtgtt

SEQ ID NO: 978870 - DNA, 25 bp, Mus musculus
ttttcctgagctttccagttgtgtt

SEQ ID NO: 978871 - DNA, 25 bp, Mus musculus
ttttcctgagttcggtattcctgaa

SEQ ID NO: 978872 - DNA, 25 bp, Mus musculus
ttttcctgagttgggtattcctgaa

SEQ ID NO: 978873 - DNA, 25 bp, Mus musculus
ttttcctgataacacctttgcccat

SEQ ID NO: 978874 - DNA, 25 bp, Mus musculus
ttttcctgataagacctttgcccat

SEQ ID NO: 978875 - DNA, 25 bp, Mus musculus
ttttcctgattgatgcttcgtggat

SEQ ID NO: 978876 - DNA, 25 bp, Mus musculus
ttttcctgattgttgcttcgtggat

SEQ ID NO: 978877 - DNA, 25 bp, Mus musculus
ttttcctgcaaaccatctacaactt

SEQ ID NO: 978878 - DNA, 25 bp, Mus musculus
ttttcctgcaaagcatctacaactt

SEQ ID NO: 978879 - DNA, 25 bp, Mus musculus
ttttcctgcaacacacagctcagtc

SEQ ID NO: 978880 - DNA, 25 bp, Mus musculus
ttttcctgcaactcacagctcagtc

SEQ ID NO: 978881 - DNA, 25 bp, Mus musculus
ttttcctgcactcactttaaaattg

SEQ ID NO: 978882 - DNA, 25 bp, Mus musculus
ttttcctgcactgactttaaaattg

SEQ ID NO: 978883 - DNA, 25 bp, Mus musculus
ttttcctgcagtagcggccccggaa

SEQ ID NO: 978884 - DNA, 25 bp, Mus musculus
ttttcctgcagtattgtttagccat

SEQ ID NO: 978885 - DNA, 25 bp, Mus musculus
ttttcctgcagttgcggccccggaa

SEQ ID NO: 978886 - DNA, 25 bp, Mus musculus
ttttcctgcagttttgtttagccat

SEQ ID NO: 978887 - DNA, 25 bp, Mus musculus
ttttcctgcatgattttactgatgt

SEQ ID NO: 978888 - DNA, 25 bp, Mus musculus
ttttcctgcatgtttttactgatgt

SEQ ID NO: 978889 - DNA, 25 bp, Mus musculus
ttttcctgcctcaacctgagtccaa

SEQ ID NO: 978890 - DNA, 25 bp, Mus musculus
ttttcctgcctctacctgagtccaa

SEQ ID NO: 978891 - DNA, 25 bp, Mus musculus
ttttcctgcctgaacacggtcatga

SEQ ID NO: 978892 - DNA, 25 bp, Mus musculus
ttttcctgcctgacttcagggagca

SEQ ID NO: 978893 - DNA, 25 bp, Mus musculus
ttttcctgcctgtacacggtcatga

SEQ ID NO: 978894 - DNA, 25 bp, Mus musculus
ttttcctgcctgtcttcagggagca

SEQ ID NO: 978895 - DNA, 25 bp, Mus musculus
ttttcctgccttagaaatgaatgct

SEQ ID NO: 978896 - DNA, 25 bp, Mus musculus
ttttcctgcctttgaaatgaatgct

SEQ ID NO: 978897 - DNA, 25 bp, Mus musculus
ttttcctgcgaaaagccatgcaacc

SEQ ID NO: 978898 - DNA, 25 bp, Mus musculus
ttttcctgcgaatagccatgcaacc

SEQ ID NO: 978899 - DNA, 25 bp, Mus musculus
ttttcctgcgtgcttaagattacag

SEQ ID NO: 978900 - DNA, 25 bp, Mus musculus
ttttcctgcgtggttaagattacag

SEQ ID NO: 978901 - DNA, 25 bp, Mus musculus
ttttcctgctcgctgaaacgaacat

SEQ ID NO: 978902 - DNA, 25 bp, Mus musculus
ttttcctgctcggtgaaacgaacat

SEQ ID NO: 978903 - DNA, 25 bp, Mus musculus
ttttcctgctctaaccttgacagtt

SEQ ID NO: 978904 - DNA, 25 bp, Mus musculus
ttttcctgctcttaccttgacagtt

SEQ ID NO: 978905 - DNA, 25 bp, Mus musculus
ttttcctgctggacttaggctgagt

SEQ ID NO: 978906 - DNA, 25 bp, Mus musculus
ttttcctgctggtcttaggctgagt

SEQ ID NO: 978907 - DNA, 25 bp, Mus musculus
ttttcctgggataatctgttcaccc

SEQ ID NO: 978908 - DNA, 25 bp, Mus musculus
ttttcctgggattatctgttcaccc

SEQ ID NO: 978909 - DNA, 25 bp, Mus musculus
ttttcctgggttacattctttctag

SEQ ID NO: 978910 - DNA, 25 bp, Mus musculus
ttttcctgggtttcattctttctag

SEQ ID NO: 978911 - DNA, 25 bp, Mus musculus
ttttcctggtctctgtcttcaattc

SEQ ID NO: 978912 - DNA, 25 bp, Mus musculus
ttttcctggtctgtgtcttcaattc

SEQ ID NO: 978913 - DNA, 25 bp, Mus musculus
ttttcctggtggagtaatgagcctt

SEQ ID NO: 978914 - DNA, 25 bp, Mus musculus
ttttcctggtggtgtaatgagcctt

SEQ ID NO: 978915 - DNA, 25 bp, Mus musculus
ttttcctgtaggacccaccataggg

SEQ ID NO: 978916 - DNA, 25 bp, Mus musculus
ttttcctgtaggtcccaccataggg

SEQ ID NO: 978917 - DNA, 25 bp, Mus musculus
ttttcctgtcacaccaaatctttga

SEQ ID NO: 978918 - DNA, 25 bp, Mus musculus
ttttcctgtcactccaaatctttga

SEQ ID NO: 978919 - DNA, 25 bp, Mus musculus
ttttcctgtggtacttaagagctat

SEQ ID NO: 978920 - DNA, 25 bp, Mus musculus
ttttcctgtggttcttaagagctat

SEQ ID NO: 978921 - DNA, 25 bp, Mus musculus
ttttcctgttctaagtgtactgcat

SEQ ID NO: 978922 - DNA, 25 bp, Mus musculus
ttttcctgttcttagtgtactgcat

SEQ ID NO: 978923 - DNA, 25 bp, Mus musculus
ttttccttaaagaactcctagtatg

SEQ ID NO: 978924 - DNA, 25 bp, Mus musculus
ttttccttaaagatctcgacaggga

SEQ ID NO: 978925 - DNA, 25 bp, Mus musculus
ttttccttaaagtactcctagtatg

SEQ ID NO: 978926 - DNA, 25 bp, Mus musculus
ttttccttaaagttctcgacaggga

SEQ ID NO: 978927 - DNA, 25 bp, Mus musculus
ttttccttacaaccttgggctgttc

SEQ ID NO: 978928 - DNA, 25 bp, Mus musculus
ttttccttacaagcttgggctgttc

SEQ ID NO: 978929 - DNA, 25 bp, Mus musculus
ttttccttcaacatactctgactca

SEQ ID NO: 978930 - DNA, 25 bp, Mus musculus
ttttccttcaacttactctgactca

SEQ ID NO: 978931 - DNA, 25 bp, Mus musculus
ttttccttcaagacagggtccatct

SEQ ID NO: 978932 - DNA, 25 bp, Mus musculus
ttttccttcaagtcagggtccatct

SEQ ID NO: 978933 - DNA, 25 bp, Mus musculus
ttttccttcagaaggcaggattccc

SEQ ID NO: 978934 - DNA, 25 bp, Mus musculus
ttttccttcagatggcaggattccc

SEQ ID NO: 978935 - DNA, 25 bp, Mus musculus
ttttccttcataaaagttgctctgt

SEQ ID NO: 978936 - DNA, 25 bp, Mus musculus
ttttccttcatataagttgctctgt

SEQ ID NO: 978937 - DNA, 25 bp, Mus musculus
ttttccttcatcacactcgctgttt

SEQ ID NO: 978938 - DNA, 25 bp, Mus musculus
ttttccttcatctcactcgctgttt

SEQ ID NO: 978939 - DNA, 25 bp, Mus musculus
ttttccttcccaactgtgtatacag

SEQ ID NO: 978940 - DNA, 25 bp, Mus musculus
ttttccttcccatctgtgtatacag

SEQ ID NO: 978941 - DNA, 25 bp, Mus musculus
ttttccttccccatacaaagtgatt

SEQ ID NO: 978942 - DNA, 25 bp, Mus musculus
ttttccttccccttacaaagtgatt

SEQ ID NO: 978943 - DNA, 25 bp, Mus musculus
ttttccttcctccctttcctgaata

SEQ ID NO: 978944 - DNA, 25 bp, Mus musculus
ttttccttcctcgctttcctgaata

SEQ ID NO: 978945 - DNA, 25 bp, Mus musculus
ttttccttccttatgtgaaagggct

SEQ ID NO: 978946 - DNA, 25 bp, Mus musculus
ttttccttccttttgtgaaagggct

SEQ ID NO: 978947 - DNA, 25 bp, Mus musculus
ttttccttcgttcgcagcgcaaagt

SEQ ID NO: 978948 - DNA, 25 bp, Mus musculus
ttttccttcgttggcagcgcaaagt

SEQ ID NO: 978949 - DNA, 25 bp, Mus musculus
ttttccttctatccatgcttagcta

SEQ ID NO: 978950 - DNA, 25 bp, Mus musculus
ttttccttctatgcatgcttagcta

SEQ ID NO: 978951 - DNA, 25 bp, Mus musculus
ttttccttctgtatctagtatttga

SEQ ID NO: 978952 - DNA, 25 bp, Mus musculus
ttttccttctgtttctagtatttga

SEQ ID NO: 978953 - DNA, 25 bp, Mus musculus
ttttccttgaggacgtgaaatactc

SEQ ID NO: 978954 - DNA, 25 bp, Mus musculus
ttttccttgaggtcgtgaaatactc

SEQ ID NO: 978955 - DNA, 25 bp, Mus musculus
ttttccttgattcttaattgcaacg

SEQ ID NO: 978956 - DNA, 25 bp, Mus musculus
ttttccttgattgttaattgcaacg

SEQ ID NO: 978957 - DNA, 25 bp, Mus musculus
ttttccttgcacactcaaaatctgt

SEQ ID NO: 978958 - DNA, 25 bp, Mus musculus
ttttccttgcactctcaaaatctgt

SEQ ID NO: 978959 - DNA, 25 bp, Mus musculus
ttttccttgcgcaattctcacaaag

SEQ ID NO: 978960 - DNA, 25 bp, Mus musculus
ttttccttgcgctattctcacaaag

SEQ ID NO: 978961 - DNA, 25 bp, Mus musculus
ttttccttgcttatcagctcatcta

SEQ ID NO: 978962 - DNA, 25 bp, Mus musculus
ttttccttgcttttcagctcatcta

SEQ ID NO: 978963 - DNA, 25 bp, Mus musculus
ttttccttggacagacttgactgta

SEQ ID NO: 978964 - DNA, 25 bp, Mus musculus
ttttccttggactgacttgactgta

SEQ ID NO: 978965 - DNA, 25 bp, Mus musculus
ttttccttggatctgtgtctcagta

SEQ ID NO: 978966 - DNA, 25 bp, Mus musculus
ttttccttggatgtgtgtctcagta

SEQ ID NO: 978967 - DNA, 25 bp, Mus musculus
ttttccttggctcttcttaaagtat

SEQ ID NO: 978968 - DNA, 25 bp, Mus musculus
ttttccttggctgttcttaaagtat

SEQ ID NO: 978969 - DNA, 25 bp, Mus musculus
ttttccttggtgactcccatctaat

SEQ ID NO: 978970 - DNA, 25 bp, Mus musculus
ttttccttggtgtctcccatctaat

SEQ ID NO: 978971 - DNA, 25 bp, Mus musculus
ttttccttggttacctgcaccaaca

SEQ ID NO: 978972 - DNA, 25 bp, Mus musculus
ttttccttggtttcctgcaccaaca

SEQ ID NO: 978973 - DNA, 25 bp, Mus musculus
ttttccttgtttacacgttggcaga

SEQ ID NO: 978974 - DNA, 25 bp, Mus musculus
ttttccttgttttcacgttggcaga

SEQ ID NO: 978975 - DNA, 25 bp, Mus musculus
ttttcctttactcgacttgggcagt

SEQ ID NO: 978976 - DNA, 25 bp, Mus musculus
ttttcctttactggacttgggcagt

SEQ ID NO: 978977 - DNA, 25 bp, Mus musculus
ttttcctttatgatctgattttgta

SEQ ID NO: 978978 - DNA, 25 bp, Mus musculus
ttttcctttatgttctgattttgta

SEQ ID NO: 978979 - DNA, 25 bp, Mus musculus
ttttcctttcaaacccagagtgttg

SEQ ID NO: 978980 - DNA, 25 bp, Mus musculus
ttttcctttcaatcccagagtgttg

SEQ ID NO: 978981 - DNA, 25 bp, Mus musculus
ttttcctttcatactgacccaaaat

SEQ ID NO: 978982 - DNA, 25 bp, Mus musculus
ttttcctttcattctgacccaaaat

SEQ ID NO: 978983 - DNA, 25 bp, Mus musculus
ttttcctttccgctcaaatgcgata

SEQ ID NO: 978984 - DNA, 25 bp, Mus musculus
ttttcctttccggtcaaatgcgata

SEQ ID NO: 978985 - DNA, 25 bp, Mus musculus
ttttcctttctaaatctggcccaga

SEQ ID NO: 978986 - DNA, 25 bp, Mus musculus
ttttcctttctacccctcatatttg

SEQ ID NO: 978987 - DNA, 25 bp, Mus musculus
ttttcctttctagccctcatatttg

SEQ ID NO: 978988 - DNA, 25 bp, Mus musculus
ttttcctttctatatctggcccaga

SEQ ID NO: 978989 - DNA, 25 bp, Mus musculus
ttttcctttctcaacctatactata

SEQ ID NO: 978990 - DNA, 25 bp, Mus musculus
ttttcctttctcaccgatgtgggaa

SEQ ID NO: 978991 - DNA, 25 bp, Mus musculus
ttttcctttctctacctatactata

SEQ ID NO: 978992 - DNA, 25 bp, Mus musculus
ttttcctttctctccgatgtgggaa

SEQ ID NO: 978993 - DNA, 25 bp, Mus musculus
ttttcctttgataaaacgtgacagc

SEQ ID NO: 978994 - DNA, 25 bp, Mus musculus
ttttcctttgattaaacgtgacagc

SEQ ID NO: 978995 - DNA, 25 bp, Mus musculus
ttttcctttgtcagagttgcagctc

SEQ ID NO: 978996 - DNA, 25 bp, Mus musculus
ttttcctttgtctgagttgcagctc

SEQ ID NO: 978997 - DNA, 25 bp, Mus musculus
ttttcctttgtgagccatatacttt

SEQ ID NO: 978998 - DNA, 25 bp, Mus musculus
ttttcctttgtgtgccatatacttt

SEQ ID NO: 978999 - DNA, 25 bp, Mus musculus
ttttccttttcaagcgctatccaca

SEQ ID NO: 979000 - DNA, 25 bp, Mus musculus
ttttccttttcatgcgctatccaca

SEQ ID NO: 979001 - DNA, 25 bp, Mus musculus
ttttccttttccctccatgagatga

SEQ ID NO: 979002 - DNA, 25 bp, Mus musculus
ttttccttttccgtccatgagatga

SEQ ID NO: 979003 - DNA, 25 bp, Mus musculus
ttttccttttctatatatctctttg

SEQ ID NO: 979004 - DNA, 25 bp, Mus musculus
ttttccttttctttatatctctttg

SEQ ID NO: 979005 - DNA, 25 bp, Mus musculus
ttttccttttgtaatgtgaacaggg

SEQ ID NO: 979006 - DNA, 25 bp, Mus musculus
ttttccttttgttatgtgaacaggg

SEQ ID NO: 979007 - DNA, 25 bp, Mus musculus
ttttccttttttctgaatctgtgaa

SEQ ID NO: 979008 - DNA, 25 bp, Mus musculus
ttttccttttttgtgaatctgtgaa

SEQ ID NO: 979009 - DNA, 25 bp, Mus musculus
ttttcgaaatttcagtgacgtgtga

SEQ ID NO: 979010 - DNA, 25 bp, Mus musculus
ttttcgaaatttgagtgacgtgtga

SEQ ID NO: 979011 - DNA, 25 bp, Mus musculus
ttttcgacccctatacagtttgcag

SEQ ID NO: 979012 - DNA, 25 bp, Mus musculus
ttttcgacccctttacagtttgcag

SEQ ID NO: 979013 - DNA, 25 bp, Mus musculus
ttttcgagaaacacttccctggtga

SEQ ID NO: 979014 - DNA, 25 bp, Mus musculus
ttttcgagaaactcttccctggtga

SEQ ID NO: 979015 - DNA, 25 bp, Mus musculus
ttttcgagctgcaggagcactacgt

SEQ ID NO: 979016 - DNA, 25 bp, Mus musculus
ttttcgagctgctggagcactacgt

SEQ ID NO: 979017 - DNA, 25 bp, Mus musculus
ttttcgatggtgaagtgcatgcaaa

SEQ ID NO: 979018 - DNA, 25 bp, Mus musculus
ttttcgatggtgtagtgcatgcaaa

SEQ ID NO: 979019 - DNA, 25 bp, Mus musculus
ttttcgccagtcattaggactgctt

SEQ ID NO: 979020 - DNA, 25 bp, Mus musculus
ttttcgccagtctttaggactgctt

SEQ ID NO: 979021 - DNA, 25 bp, Mus musculus
ttttcgcccagacagcagtgtggac

SEQ ID NO: 979022 - DNA, 25 bp, Mus musculus
ttttcgcccagagagcagtgtggac

SEQ ID NO: 979023 - DNA, 25 bp, Mus musculus
ttttcgcctgcaattctatacagcc

SEQ ID NO: 979024 - DNA, 25 bp, Mus musculus
ttttcgcctgcatttctatacagcc

SEQ ID NO: 979025 - DNA, 25 bp, Mus musculus
ttttcgcctgtgcaatgcggcacta

SEQ ID NO: 979026 - DNA, 25 bp, Mus musculus
ttttcgcctgtggaatgcggcacta

SEQ ID NO: 979027 - DNA, 25 bp, Mus musculus
ttttcgctgcttctcactataacca

SEQ ID NO: 979028 - DNA, 25 bp, Mus musculus
ttttcgctgcttgtcactataacca

SEQ ID NO: 979029 - DNA, 25 bp, Mus musculus
ttttcggaaaagagccagtcaagtg

SEQ ID NO: 979030 - DNA, 25 bp, Mus musculus
ttttcggaaaagtgccagtcaagtg

SEQ ID NO: 979031 - DNA, 25 bp, Mus musculus
ttttcggacattacacttcagtgct

SEQ ID NO: 979032 - DNA, 25 bp, Mus musculus
ttttcggacatttcacttcagtgct

SEQ ID NO: 979033 - DNA, 25 bp, Mus musculus
ttttcggagcgacagttgagacaca

SEQ ID NO: 979034 - DNA, 25 bp, Mus musculus
ttttcggagcgagagttgagacaca

SEQ ID NO: 979035 - DNA, 25 bp, Mus musculus
ttttcggcagtcataagctccactg

SEQ ID NO: 979036 - DNA, 25 bp, Mus musculus
ttttcggcagtcttaagctccactg

SEQ ID NO: 979037 - DNA, 25 bp, Mus musculus
ttttcggcatttcaagtccccagac

SEQ ID NO: 979038 - DNA, 25 bp, Mus musculus
ttttcggcatttgaagtccccagac

SEQ ID NO: 979039 - DNA, 25 bp, Mus musculus
ttttcggccactctgatactggagc

SEQ ID NO: 979040 - DNA, 25 bp, Mus musculus
ttttcggccactgtgatactggagc

SEQ ID NO: 979041 - DNA, 25 bp, Mus musculus
ttttcggccatcctaagaccaaagg

SEQ ID NO: 979042 - DNA, 25 bp, Mus musculus
ttttcggccatcgtaagaccaaagg

SEQ ID NO: 979043 - DNA, 25 bp, Mus musculus
ttttcggcccttctataataaatag

SEQ ID NO: 979044 - DNA, 25 bp, Mus musculus
ttttcggcccttgtataataaatag

SEQ ID NO: 979045 - DNA, 25 bp, Mus musculus
ttttcgggctccaagttgcctgcag

SEQ ID NO: 979046 - DNA, 25 bp, Mus musculus
ttttcgggctcctagttgcctgcag

SEQ ID NO: 979047 - DNA, 25 bp, Mus musculus
ttttcggttccaattttgcactctt

SEQ ID NO: 979048 - DNA, 25 bp, Mus musculus
ttttcggttccatttttgcactctt

SEQ ID NO: 979049 - DNA, 25 bp, Mus musculus
ttttcggttttgatccattggtgat

SEQ ID NO: 979050 - DNA, 25 bp, Mus musculus
ttttcggttttgttccattggtgat

SEQ ID NO: 979051 - DNA, 25 bp, Mus musculus
ttttcgtaactaccctcgtttccag

SEQ ID NO: 979052 - DNA, 25 bp, Mus musculus
ttttcgtaactagcctcgtttccag

SEQ ID NO: 979053 - DNA, 25 bp, Mus musculus
ttttcgtccaaacccgcctgcaaga

SEQ ID NO: 979054 - DNA, 25 bp, Mus musculus
ttttcgtccaaagccgcctgcaaga

SEQ ID NO: 979055 - DNA, 25 bp, Mus musculus
ttttcgtcccaacagtggaatgtaa

SEQ ID NO: 979056 - DNA, 25 bp, Mus musculus
ttttcgtcccaagagtggaatgtaa

SEQ ID NO: 979057 - DNA, 25 bp, Mus musculus
ttttcgtcctcacgcgaagctggtt

SEQ ID NO: 979058 - DNA, 25 bp, Mus musculus
ttttcgtcctcaggcgaagctggtt

SEQ ID NO: 979059 - DNA, 25 bp, Mus musculus
ttttcgtcttaccacatgccttact

SEQ ID NO: 979060 - DNA, 25 bp, Mus musculus
ttttcgtcttacgacatgccttact

SEQ ID NO: 979061 - DNA, 25 bp, Mus musculus
ttttcgtgactaatcccctgtaaat

SEQ ID NO: 979062 - DNA, 25 bp, Mus musculus
ttttcgtgactattcccctgtaaat

SEQ ID NO: 979063 - DNA, 25 bp, Mus musculus
ttttcgtgcactcgtcttgacagga

SEQ ID NO: 979064 - DNA, 25 bp, Mus musculus
ttttcgtgcactggtcttgacagga

SEQ ID NO: 979065 - DNA, 25 bp, Mus musculus
ttttcgtgcagaagatgcggctcct

SEQ ID NO: 979066 - DNA, 25 bp, Mus musculus
ttttcgtgcagatgatgcggctcct

SEQ ID NO: 979067 - DNA, 25 bp, Mus musculus
ttttcgtgtgttaccctgctcattt

SEQ ID NO: 979068 - DNA, 25 bp, Mus musculus
ttttcgtgtgtttccctgctcattt

SEQ ID NO: 979069 - DNA, 25 bp, Mus musculus
ttttcgttgagcagtcccctagaga

SEQ ID NO: 979070 - DNA, 25 bp, Mus musculus
ttttcgttgagctgtcccctagaga

SEQ ID NO: 979071 - DNA, 25 bp, Mus musculus
ttttcgttgctaacttatacctgta

SEQ ID NO: 979072 - DNA, 25 bp, Mus musculus
ttttcgttgctatcttatacctgta

SEQ ID NO: 979073 - DNA, 25 bp, Mus musculus
ttttcgtttgaactcatcggccgcc

SEQ ID NO: 979074 - DNA, 25 bp, Mus musculus
ttttcgtttgaagtcatcggccgcc

SEQ ID NO: 979075 - DNA, 25 bp, Mus musculus
ttttcgttttatatagtcctgctta

SEQ ID NO: 979076 - DNA, 25 bp, Mus musculus
ttttcgttttatttagtcctgctta

SEQ ID NO: 979077 - DNA, 25 bp, Mus musculus
ttttctaaaactagccatagtgaaa

SEQ ID NO: 979078 - DNA, 25 bp, Mus musculus
ttttctaaaacttgccatagtgaaa

SEQ ID NO: 979079 - DNA, 25 bp, Mus musculus
ttttctaaacatacctgtcccgaag

SEQ ID NO: 979080 - DNA, 25 bp, Mus musculus
ttttctaaacattcctgtcccgaag

SEQ ID NO: 979081 - DNA, 25 bp, Mus musculus
ttttctaaactaccacaagctcctg

SEQ ID NO: 979082 - DNA, 25 bp, Mus musculus
ttttctaaactagcacaagctcctg

SEQ ID NO: 979083 - DNA, 25 bp, Mus musculus
ttttctaaagcaccttgatgacaag

SEQ ID NO: 979084 - DNA, 25 bp, Mus musculus
ttttctaaagcagcttgatgacaag

SEQ ID NO: 979085 - DNA, 25 bp, Mus musculus
ttttctaaaggcactggcttccgtc

SEQ ID NO: 979086 - DNA, 25 bp, Mus musculus
ttttctaaaggctctggcttccgtc

SEQ ID NO: 979087 - DNA, 25 bp, Mus musculus
ttttctaacctaacactgcacacat

SEQ ID NO: 979088 - DNA, 25 bp, Mus musculus
ttttctaacctatcactgcacacat

SEQ ID NO: 979089 - DNA, 25 bp, Mus musculus
ttttctaaccttacacactgtcttc

SEQ ID NO: 979090 - DNA, 25 bp, Mus musculus
ttttctaacctttcacactgtcttc

SEQ ID NO: 979091 - DNA, 25 bp, Mus musculus
ttttctaactcacttgggaacattt

SEQ ID NO: 979092 - DNA, 25 bp, Mus musculus
ttttctaactcagttgggaacattt

SEQ ID NO: 979093 - DNA, 25 bp, Mus musculus
ttttctaactccatcactgttcagg

SEQ ID NO: 979094 - DNA, 25 bp, Mus musculus
ttttctaactccttcactgttcagg

SEQ ID NO: 979095 - DNA, 25 bp, Mus musculus
ttttctaactggatttctgagccta

SEQ ID NO: 979096 - DNA, 25 bp, Mus musculus
ttttctaactggttttctgagccta

SEQ ID NO: 979097 - DNA, 25 bp, Mus musculus
ttttctaaggctcgctgtggtggca

SEQ ID NO: 979098 - DNA, 25 bp, Mus musculus
ttttctaaggctggctgtggtggca

SEQ ID NO: 979099 - DNA, 25 bp, Mus musculus
ttttctaatacacacatctcaggta

SEQ ID NO: 979100 - DNA, 25 bp, Mus musculus
ttttctaatacagacatctcaggta

SEQ ID NO: 979101 - DNA, 25 bp, Mus musculus
ttttctaataccaagcctccactag

SEQ ID NO: 979102 - DNA, 25 bp, Mus musculus
ttttctaatacctagcctccactag

SEQ ID NO: 979103 - DNA, 25 bp, Mus musculus
ttttctaatcttagtgtatttgcac

SEQ ID NO: 979104 - DNA, 25 bp, Mus musculus
ttttctaatctttgtgtatttgcac

SEQ ID NO: 979105 - DNA, 25 bp, Mus musculus
ttttctaatgccagaggccttaaaa

SEQ ID NO: 979106 - DNA, 25 bp, Mus musculus
ttttctaatgcctgaggccttaaaa

SEQ ID NO: 979107 - DNA, 25 bp, Mus musculus
ttttctaatttgactgtccaggaag

SEQ ID NO: 979108 - DNA, 25 bp, Mus musculus
ttttctaatttgtctgtccaggaag

SEQ ID NO: 979109 - DNA, 25 bp, Mus musculus
ttttctacactgatctcttcagagg

SEQ ID NO: 979110 - DNA, 25 bp, Mus musculus
ttttctacactgttctcttcagagg

SEQ ID NO: 979111 - DNA, 25 bp, Mus musculus
ttttctacagcgacagcaagtgtct

SEQ ID NO: 979112 - DNA, 25 bp, Mus musculus
ttttctacagcgtcagcaagtgtct

SEQ ID NO: 979113 - DNA, 25 bp, Mus musculus
ttttctacatggactcagagggtaa

SEQ ID NO: 979114 - DNA, 25 bp, Mus musculus
ttttctacatggtctcagagggtaa

SEQ ID NO: 979115 - DNA, 25 bp, Mus musculus
ttttctacatgtaaagctctgcagt

SEQ ID NO: 979116 - DNA, 25 bp, Mus musculus
ttttctacatgttaagctctgcagt

SEQ ID NO: 979117 - DNA, 25 bp, Mus musculus
ttttctaccaataatcctctcacaa

SEQ ID NO: 979118 - DNA, 25 bp, Mus musculus
ttttctaccaatctaaaggtgtggc

SEQ ID NO: 979119 - DNA, 25 bp, Mus musculus
ttttctaccaatgtaaaggtgtggc

SEQ ID NO: 979120 - DNA, 25 bp, Mus musculus
ttttctaccaattatcctctcacaa

SEQ ID NO: 979121 - DNA, 25 bp, Mus musculus
ttttctaccatgaaaatgtgcaatg

SEQ ID NO: 979122 - DNA, 25 bp, Mus musculus
ttttctaccatgtaaatgtgcaatg

SEQ ID NO: 979123 - DNA, 25 bp, Mus musculus
ttttctaccattaaagtcctttgtg

SEQ ID NO: 979124 - DNA, 25 bp, Mus musculus
ttttctaccatttaagtcctttgtg

SEQ ID NO: 979125 - DNA, 25 bp, Mus musculus
ttttctaccctcatgagaatgtgag

SEQ ID NO: 979126 - DNA, 25 bp, Mus musculus
ttttctaccctcttgagaatgtgag

SEQ ID NO: 979127 - DNA, 25 bp, Mus musculus
ttttctacccttagttgtgaccaca

SEQ ID NO: 979128 - DNA, 25 bp, Mus musculus
ttttctaccctttgttgtgaccaca

SEQ ID NO: 979129 - DNA, 25 bp, Mus musculus
ttttctaccgacaaatttcaggaag

SEQ ID NO: 979130 - DNA, 25 bp, Mus musculus
ttttctaccgactaatttcaggaag

SEQ ID NO: 979131 - DNA, 25 bp, Mus musculus
ttttctacctataacattttctctt

SEQ ID NO: 979132 - DNA, 25 bp, Mus musculus
ttttctacctatcattcaactgttt

SEQ ID NO: 979133 - DNA, 25 bp, Mus musculus
ttttctacctatgattcaactgttt

SEQ ID NO: 979134 - DNA, 25 bp, Mus musculus
ttttctacctattacattttctctt

SEQ ID NO: 979135 - DNA, 25 bp, Mus musculus
ttttctacctcccaatggtggtgat

SEQ ID NO: 979136 - DNA, 25 bp, Mus musculus
ttttctacctccgaatggtggtgat

SEQ ID NO: 979137 - DNA, 25 bp, Mus musculus
ttttctacctgaaaacactgtttac

SEQ ID NO: 979138 - DNA, 25 bp, Mus musculus
ttttctacctgataacactgtttac

SEQ ID NO: 979139 - DNA, 25 bp, Mus musculus
ttttctactccaacaccataatcat

SEQ ID NO: 979140 - DNA, 25 bp, Mus musculus
ttttctactccatcaccataatcat

SEQ ID NO: 979141 - DNA, 25 bp, Mus musculus
ttttctactcgtccattccagctgt

SEQ ID NO: 979142 - DNA, 25 bp, Mus musculus
ttttctactcgtgcattccagctgt

SEQ ID NO: 979143 - DNA, 25 bp, Mus musculus
ttttctactctacctgaatggcttt

SEQ ID NO: 979144 - DNA, 25 bp, Mus musculus
ttttctactctagctgaatggcttt

SEQ ID NO: 979145 - DNA, 25 bp, Mus musculus
ttttctactctcatgccatcttttt

SEQ ID NO: 979146 - DNA, 25 bp, Mus musculus
ttttctactctcttgccatcttttt

SEQ ID NO: 979147 - DNA, 25 bp, Mus musculus
ttttctagaatccagttgacttgtg

SEQ ID NO: 979148 - DNA, 25 bp, Mus musculus
ttttctagaatcgagttgacttgtg

SEQ ID NO: 979149 - DNA, 25 bp, Mus musculus
ttttctagactccagagggtgtcaa

SEQ ID NO: 979150 - DNA, 25 bp, Mus musculus
ttttctagactcgagagggtgtcaa

SEQ ID NO: 979151 - DNA, 25 bp, Mus musculus
ttttctagagaacattagtgacaat

SEQ ID NO: 979152 - DNA, 25 bp, Mus musculus
ttttctagagaagattagtgacaat

SEQ ID NO: 979153 - DNA, 25 bp, Mus musculus
ttttctagattaatccagccagcct

SEQ ID NO: 979154 - DNA, 25 bp, Mus musculus
ttttctagattattccagccagcct

SEQ ID NO: 979155 - DNA, 25 bp, Mus musculus
ttttctagattcaccagtgctgacc

SEQ ID NO: 979156 - DNA, 25 bp, Mus musculus
ttttctagattctccagtgctgacc

SEQ ID NO: 979157 - DNA, 25 bp, Mus musculus
ttttctagcagacagtctcttccca

SEQ ID NO: 979158 - DNA, 25 bp, Mus musculus
ttttctagcagagagtctcttccca

SEQ ID NO: 979159 - DNA, 25 bp, Mus musculus
ttttctagcctgagccagccatgtt

SEQ ID NO: 979160 - DNA, 25 bp, Mus musculus
ttttctagcctgtgccagccatgtt

SEQ ID NO: 979161 - DNA, 25 bp, Mus musculus
ttttctagcttcactgacaccggaa

SEQ ID NO: 979162 - DNA, 25 bp, Mus musculus
ttttctagcttcagccatggctcaa

SEQ ID NO: 979163 - DNA, 25 bp, Mus musculus
ttttctagcttctctgacaccggaa

SEQ ID NO: 979164 - DNA, 25 bp, Mus musculus
ttttctagcttctgccatggctcaa

SEQ ID NO: 979165 - DNA, 25 bp, Mus musculus
ttttctaggaccagttcctgctcta

SEQ ID NO: 979166 - DNA, 25 bp, Mus musculus
ttttctaggacctgttcctgctcta

SEQ ID NO: 979167 - DNA, 25 bp, Mus musculus
ttttctaggactctgtgcacctgtt

SEQ ID NO: 979168 - DNA, 25 bp, Mus musculus
ttttctaggactgtgtgcacctgtt

SEQ ID NO: 979169 - DNA, 25 bp, Mus musculus
ttttctaggagcagcggtgttccgc

SEQ ID NO: 979170 - DNA, 25 bp, Mus musculus
ttttctaggagctgcggtgttccgc

SEQ ID NO: 979171 - DNA, 25 bp, Mus musculus
ttttctaggccgatttggtctacag

SEQ ID NO: 979172 - DNA, 25 bp, Mus musculus
ttttctaggccgttttggtctacag

SEQ ID NO: 979173 - DNA, 25 bp, Mus musculus
ttttctagtatgaaacagtgcctta

SEQ ID NO: 979174 - DNA, 25 bp, Mus musculus
ttttctagtatgtaacagtgcctta

SEQ ID NO: 979175 - DNA, 25 bp, Mus musculus
ttttctagtccaaacttctgtaccc

SEQ ID NO: 979176 - DNA, 25 bp, Mus musculus
ttttctagtccatacttctgtaccc

SEQ ID NO: 979177 - DNA, 25 bp, Mus musculus
ttttctagttagatgtatcttcctt

SEQ ID NO: 979178 - DNA, 25 bp, Mus musculus
ttttctagttagttgtatcttcctt

SEQ ID NO: 979179 - DNA, 25 bp, Mus musculus
ttttctataaaacgctgtatatcga

SEQ ID NO: 979180 - DNA, 25 bp, Mus musculus
ttttctataaaaggctgtatatcga

SEQ ID NO: 979181 - DNA, 25 bp, Mus musculus
ttttctatagccaccccacagaaat

SEQ ID NO: 979182 - DNA, 25 bp, Mus musculus
ttttctatagcctccccacagaaat

SEQ ID NO: 979183 - DNA, 25 bp, Mus musculus
ttttctatcaagatcctgaatggaa

SEQ ID NO: 979184 - DNA, 25 bp, Mus musculus
ttttctatcaagttcctgaatggaa

SEQ ID NO: 979185 - DNA, 25 bp, Mus musculus
ttttctatcaccagacctgacgaag

SEQ ID NO: 979186 - DNA, 25 bp, Mus musculus
ttttctatcacctgacctgacgaag

SEQ ID NO: 979187 - DNA, 25 bp, Mus musculus
ttttctatcagaaccattatactta

SEQ ID NO: 979188 - DNA, 25 bp, Mus musculus
ttttctatcagatccattatactta

SEQ ID NO: 979189 - DNA, 25 bp, Mus musculus
ttttctatcctaaatctgactttgc

SEQ ID NO: 979190 - DNA, 25 bp, Mus musculus
ttttctatcctaactatcctatctg

SEQ ID NO: 979191 - DNA, 25 bp, Mus musculus
ttttctatcctatatctgactttgc

SEQ ID NO: 979192 - DNA, 25 bp, Mus musculus
ttttctatcctatctatcctatctg

SEQ ID NO: 979193 - DNA, 25 bp, Mus musculus
ttttctatcgttatcaaagactcat

SEQ ID NO: 979194 - DNA, 25 bp, Mus musculus
ttttctatcgttttcaaagactcat

SEQ ID NO: 979195 - DNA, 25 bp, Mus musculus
ttttctatctgcctgtagctctcca

SEQ ID NO: 979196 - DNA, 25 bp, Mus musculus
ttttctatctgcgtgtagctctcca

SEQ ID NO: 979197 - DNA, 25 bp, Mus musculus
ttttctatgactatgccactgtgca

SEQ ID NO: 979198 - DNA, 25 bp, Mus musculus
ttttctatgactttgccactgtgca

SEQ ID NO: 979199 - DNA, 25 bp, Mus musculus
ttttctatggccaggactctctgat

SEQ ID NO: 979200 - DNA, 25 bp, Mus musculus
ttttctatggcctggactctctgat

SEQ ID NO: 979201 - DNA, 25 bp, Mus musculus
ttttctatgggtcttatcacctagc

SEQ ID NO: 979202 - DNA, 25 bp, Mus musculus
ttttctatgggtgttatcacctagc

SEQ ID NO: 979203 - DNA, 25 bp, Mus musculus
ttttctattaccaggccgctgaaag

SEQ ID NO: 979204 - DNA, 25 bp, Mus musculus
ttttctattacctggccgctgaaag

SEQ ID NO: 979205 - DNA, 25 bp, Mus musculus
ttttctattcacatgatggttgtga

SEQ ID NO: 979206 - DNA, 25 bp, Mus musculus
ttttctattcacttgatggttgtga

SEQ ID NO: 979207 - DNA, 25 bp, Mus musculus
ttttctattctgaaagtctaagggt

SEQ ID NO: 979208 - DNA, 25 bp, Mus musculus
ttttctattctgagatacctgggtg

SEQ ID NO: 979209 - DNA, 25 bp, Mus musculus
ttttctattctgattacagtgcgtc

SEQ ID NO: 979210 - DNA, 25 bp, Mus musculus
ttttctattctgtaagtctaagggt

SEQ ID NO: 979211 - DNA, 25 bp, Mus musculus
ttttctattctgtgatacctgggtg

SEQ ID NO: 979212 - DNA, 25 bp, Mus musculus
ttttctattctgtttacagtgcgtc

SEQ ID NO: 979213 - DNA, 25 bp, Mus musculus
ttttctattggtatcccaagcactg

SEQ ID NO: 979214 - DNA, 25 bp, Mus musculus
ttttctattggtttcccaagcactg

SEQ ID NO: 979215 - DNA, 25 bp, Mus musculus
ttttctattgttacataatcccata

SEQ ID NO: 979216 - DNA, 25 bp, Mus musculus
ttttctattgttcatttctctcttg

SEQ ID NO: 979217 - DNA, 25 bp, Mus musculus
ttttctattgttccgatagccttgc

SEQ ID NO: 979218 - DNA, 25 bp, Mus musculus
ttttctattgttgatttctctcttg

SEQ ID NO: 979219 - DNA, 25 bp, Mus musculus
ttttctattgttgcgatagccttgc

SEQ ID NO: 979220 - DNA, 25 bp, Mus musculus
ttttctattgtttcataatcccata

SEQ ID NO: 979221 - DNA, 25 bp, Mus musculus
ttttctatttccagctatccgacaa

SEQ ID NO: 979222 - DNA, 25 bp, Mus musculus
ttttctatttccatgcacagtgtaa

SEQ ID NO: 979223 - DNA, 25 bp, Mus musculus
ttttctatttcctgctatccgacaa

SEQ ID NO: 979224 - DNA, 25 bp, Mus musculus
ttttctatttccttgcacagtgtaa

SEQ ID NO: 979225 - DNA, 25 bp, Mus musculus
ttttctcaaatactgccattcctgg

SEQ ID NO: 979226 - DNA, 25 bp, Mus musculus
ttttctcaaatagtgccattcctgg

SEQ ID NO: 979227 - DNA, 25 bp, Mus musculus
ttttctcaaatgcaggcgtcttcca

SEQ ID NO: 979228 - DNA, 25 bp, Mus musculus
ttttctcaaatggaggcgtcttcca

SEQ ID NO: 979229 - DNA, 25 bp, Mus musculus
ttttctcaacccaccagtctgggaa

SEQ ID NO: 979230 - DNA, 25 bp, Mus musculus
ttttctcaaccctccagtctgggaa

SEQ ID NO: 979231 - DNA, 25 bp, Mus musculus
ttttctcaacctcaattgtagcctt

SEQ ID NO: 979232 - DNA, 25 bp, Mus musculus
ttttctcaacctgaattgtagcctt

SEQ ID NO: 979233 - DNA, 25 bp, Mus musculus
ttttctcaagatccactcgagtgat

SEQ ID NO: 979234 - DNA, 25 bp, Mus musculus
ttttctcaagatgcactcgagtgat

SEQ ID NO: 979235 - DNA, 25 bp, Mus musculus
ttttctcaatctcttcctctacatt

SEQ ID NO: 979236 - DNA, 25 bp, Mus musculus
ttttctcaatctgttcctctacatt

SEQ ID NO: 979237 - DNA, 25 bp, Mus musculus
ttttctcacatcattgtctccacaa

SEQ ID NO: 979238 - DNA, 25 bp, Mus musculus
ttttctcacatctttgtctccacaa

SEQ ID NO: 979239 - DNA, 25 bp, Mus musculus
ttttctcacctgatatcttcaccaa

SEQ ID NO: 979240 - DNA, 25 bp, Mus musculus
ttttctcacctgttatcttcaccaa

SEQ ID NO: 979241 - DNA, 25 bp, Mus musculus
ttttctcacttcctcttaattctgg

SEQ ID NO: 979242 - DNA, 25 bp, Mus musculus
ttttctcacttcgtcttaattctgg

SEQ ID NO: 979243 - DNA, 25 bp, Mus musculus
ttttctcagacaagaagtccccggg

SEQ ID NO: 979244 - DNA, 25 bp, Mus musculus
ttttctcagacatgaagtccccggg

SEQ ID NO: 979245 - DNA, 25 bp, Mus musculus
ttttctcagagcctttagtccgaga

SEQ ID NO: 979246 - DNA, 25 bp, Mus musculus
ttttctcagagcgtttagtccgaga

SEQ ID NO: 979247 - DNA, 25 bp, Mus musculus
ttttctcagcaaatacgatgtattc

SEQ ID NO: 979248 - DNA, 25 bp, Mus musculus
ttttctcagcaattacgatgtattc

SEQ ID NO: 979249 - DNA, 25 bp, Mus musculus
ttttctcagcagaggatcagggccc

SEQ ID NO: 979250 - DNA, 25 bp, Mus musculus
ttttctcagcagtggatcagggccc

SEQ ID NO: 979251 - DNA, 25 bp, Mus musculus
ttttctcagcttaaaggctcatcag

SEQ ID NO: 979252 - DNA, 25 bp, Mus musculus
ttttctcagctttaaggctcatcag

SEQ ID NO: 979253 - DNA, 25 bp, Mus musculus
ttttctcaggatagtcatagctcag

SEQ ID NO: 979254 - DNA, 25 bp, Mus musculus
ttttctcaggattgtcatagctcag

SEQ ID NO: 979255 - DNA, 25 bp, Mus musculus
ttttctcagggactggaaaggtcac

SEQ ID NO: 979256 - DNA, 25 bp, Mus musculus
ttttctcagggagtggaaaggtcac

SEQ ID NO: 979257 - DNA, 25 bp, Mus musculus
ttttctcagtgaaggttgatgaaga

SEQ ID NO: 979258 - DNA, 25 bp, Mus musculus
ttttctcagtgatggttgatgaaga

SEQ ID NO: 979259 - DNA, 25 bp, Mus musculus
ttttctcatcaacatgtaataaaag

SEQ ID NO: 979260 - DNA, 25 bp, Mus musculus
ttttctcatcaagatgtaataaaag

SEQ ID NO: 979261 - DNA, 25 bp, Mus musculus
ttttctcattgactccaacgtgttc

SEQ ID NO: 979262 - DNA, 25 bp, Mus musculus
ttttctcattgagtccaacgtgttc

SEQ ID NO: 979263 - DNA, 25 bp, Mus musculus
ttttctcatttaatctgtacccaac

SEQ ID NO: 979264 - DNA, 25 bp, Mus musculus
ttttctcatttattctgtacccaac

SEQ ID NO: 979265 - DNA, 25 bp, Mus musculus
ttttctcatttcaagcattcgtttg

SEQ ID NO: 979266 - DNA, 25 bp, Mus musculus
ttttctcatttctagcattcgtttg

SEQ ID NO: 979267 - DNA, 25 bp, Mus musculus
ttttctcatttgatcaccatagtaa

SEQ ID NO: 979268 - DNA, 25 bp, Mus musculus
ttttctcatttgttcaccatagtaa

SEQ ID NO: 979269 - DNA, 25 bp, Mus musculus
ttttctccaaaactggcttttctga

SEQ ID NO: 979270 - DNA, 25 bp, Mus musculus
ttttctccaaaagtggcttttctga

SEQ ID NO: 979271 - DNA, 25 bp, Mus musculus
ttttctccaaagctgtgaaacttat

SEQ ID NO: 979272 - DNA, 25 bp, Mus musculus
ttttctccaaaggtgtgaaacttat

SEQ ID NO: 979273 - DNA, 25 bp, Mus musculus
ttttctccaagcacatgtccgtatg

SEQ ID NO: 979274 - DNA, 25 bp, Mus musculus
ttttctccaagctcatgtccgtatg

SEQ ID NO: 979275 - DNA, 25 bp, Mus musculus
ttttctccactcacaaagcattttg

SEQ ID NO: 979276 - DNA, 25 bp, Mus musculus
ttttctccactctcaaagcattttg

SEQ ID NO: 979277 - DNA, 25 bp, Mus musculus
ttttctccagatctgtaaggcccat

SEQ ID NO: 979278 - DNA, 25 bp, Mus musculus
ttttctccagatgtgtaaggcccat

SEQ ID NO: 979279 - DNA, 25 bp, Mus musculus
ttttctccaggtcgcttttatctta

SEQ ID NO: 979280 - DNA, 25 bp, Mus musculus
ttttctccaggtggcttttatctta

SEQ ID NO: 979281 - DNA, 25 bp, Mus musculus
ttttctccagtacagttcagccact

SEQ ID NO: 979282 - DNA, 25 bp, Mus musculus
ttttctccagtagagttcagccact

SEQ ID NO: 979283 - DNA, 25 bp, Mus musculus
ttttctccatagatggtctgctccc

SEQ ID NO: 979284 - DNA, 25 bp, Mus musculus
ttttctccatagttggtctgctccc

SEQ ID NO: 979285 - DNA, 25 bp, Mus musculus
ttttctccatccaagctaccacgtg

SEQ ID NO: 979286 - DNA, 25 bp, Mus musculus
ttttctccatccatctcactgtggt

SEQ ID NO: 979287 - DNA, 25 bp, Mus musculus
ttttctccatcctagctaccacgtg

SEQ ID NO: 979288 - DNA, 25 bp, Mus musculus
ttttctccatccttctcactgtggt

SEQ ID NO: 979289 - DNA, 25 bp, Mus musculus
ttttctccatgtacctctgagacat

SEQ ID NO: 979290 - DNA, 25 bp, Mus musculus
ttttctccatgtcatgagcgtgagt

SEQ ID NO: 979291 - DNA, 25 bp, Mus musculus
ttttctccatgtgatgagcgtgagt

SEQ ID NO: 979292 - DNA, 25 bp, Mus musculus
ttttctccatgttcctctgagacat

SEQ ID NO: 979293 - DNA, 25 bp, Mus musculus
ttttctccatttattacttggctat

SEQ ID NO: 979294 - DNA, 25 bp, Mus musculus
ttttctccattttttacttggctat

SEQ ID NO: 979295 - DNA, 25 bp, Mus musculus
ttttctcccaaactcaattttgctg

SEQ ID NO: 979296 - DNA, 25 bp, Mus musculus
ttttctcccaaagtcaattttgctg

SEQ ID NO: 979297 - DNA, 25 bp, Mus musculus
ttttctcccataagtttaaactcgg

SEQ ID NO: 979298 - DNA, 25 bp, Mus musculus
ttttctcccatatgtttaaactcgg

SEQ ID NO: 979299 - DNA, 25 bp, Mus musculus
ttttctccccagatgttttttgagg

SEQ ID NO: 979300 - DNA, 25 bp, Mus musculus
ttttctccccagttgttttttgagg

SEQ ID NO: 979301 - DNA, 25 bp, Mus musculus
ttttctcccctcaaattagctgtaa

SEQ ID NO: 979302 - DNA, 25 bp, Mus musculus
ttttctcccctctaattagctgtaa

SEQ ID NO: 979303 - DNA, 25 bp, Mus musculus
ttttctccccttagcagtaggactt

SEQ ID NO: 979304 - DNA, 25 bp, Mus musculus
ttttctcccctttgcagtaggactt

SEQ ID NO: 979305 - DNA, 25 bp, Mus musculus
ttttctcccgagcaaagtctcacag

SEQ ID NO: 979306 - DNA, 25 bp, Mus musculus
ttttctcccgaggaaagtctcacag

SEQ ID NO: 979307 - DNA, 25 bp, Mus musculus
ttttctcccggtactgaggaagtag

SEQ ID NO: 979308 - DNA, 25 bp, Mus musculus
ttttctcccggttctgaggaagtag

SEQ ID NO: 979309 - DNA, 25 bp, Mus musculus
ttttctccctaacttatctcttatc

SEQ ID NO: 979310 - DNA, 25 bp, Mus musculus
ttttctccctaagttatctcttatc

SEQ ID NO: 979311 - DNA, 25 bp, Mus musculus
ttttctccctagatgactctgatct

SEQ ID NO: 979312 - DNA, 25 bp, Mus musculus
ttttctccctagttgactctgatct

SEQ ID NO: 979313 - DNA, 25 bp, Mus musculus
ttttctccctccaatggggatgcca

SEQ ID NO: 979314 - DNA, 25 bp, Mus musculus
ttttctccctcctatggggatgcca

SEQ ID NO: 979315 - DNA, 25 bp, Mus musculus
ttttctcctagacaacccttgaact

SEQ ID NO: 979316 - DNA, 25 bp, Mus musculus
ttttctcctagagaacccttgaact

SEQ ID NO: 979317 - DNA, 25 bp, Mus musculus
ttttctcctcataggtaagttttgc

SEQ ID NO: 979318 - DNA, 25 bp, Mus musculus
ttttctcctcattggtaagttttgc

SEQ ID NO: 979319 - DNA, 25 bp, Mus musculus
ttttctcctccaagtgggcacaagg

SEQ ID NO: 979320 - DNA, 25 bp, Mus musculus
ttttctcctccatgtgggcacaagg

SEQ ID NO: 979321 - DNA, 25 bp, Mus musculus
ttttctcctccccatagatggtagc

SEQ ID NO: 979322 - DNA, 25 bp, Mus musculus
ttttctcctcccgatagatggtagc

SEQ ID NO: 979323 - DNA, 25 bp, Mus musculus
ttttctcctctgagccatgtgatca

SEQ ID NO: 979324 - DNA, 25 bp, Mus musculus
ttttctcctctgtgccatgtgatca

SEQ ID NO: 979325 - DNA, 25 bp, Mus musculus
ttttctcctcttaccatgaatggcg

SEQ ID NO: 979326 - DNA, 25 bp, Mus musculus
ttttctcctctttccatgaatggcg

SEQ ID NO: 979327 - DNA, 25 bp, Mus musculus
ttttctcctgaaatcgatgcatcgc

SEQ ID NO: 979328 - DNA, 25 bp, Mus musculus
ttttctcctgaattcgatgcatcgc

SEQ ID NO: 979329 - DNA, 25 bp, Mus musculus
ttttctcctgcaataaggcttgacc

SEQ ID NO: 979330 - DNA, 25 bp, Mus musculus
ttttctcctgcattaaggcttgacc

SEQ ID NO: 979331 - DNA, 25 bp, Mus musculus
ttttctcctgctctttttattgaca

SEQ ID NO: 979332 - DNA, 25 bp, Mus musculus
ttttctcctgctgtttttattgaca

SEQ ID NO: 979333 - DNA, 25 bp, Mus musculus
ttttctccttagacctctgagtgca

SEQ ID NO: 979334 - DNA, 25 bp, Mus musculus
ttttctccttagtcctctgagtgca

SEQ ID NO: 979335 - DNA, 25 bp, Mus musculus
ttttctcctttgcagctcgtccaga

SEQ ID NO: 979336 - DNA, 25 bp, Mus musculus
ttttctcctttggagctcgtccaga

SEQ ID NO: 979337 - DNA, 25 bp, Mus musculus
ttttctcgccttatggttgaacgat

SEQ ID NO: 979338 - DNA, 25 bp, Mus musculus
ttttctcgccttttggttgaacgat

SEQ ID NO: 979339 - DNA, 25 bp, Mus musculus
ttttctcggactctgccgggcgcga

SEQ ID NO: 979340 - DNA, 25 bp, Mus musculus
ttttctcggactgtgccgggcgcga

SEQ ID NO: 979341 - DNA, 25 bp, Mus musculus
ttttctcgtgacaagaagccgtggc

SEQ ID NO: 979342 - DNA, 25 bp, Mus musculus
ttttctcgtgactagaagccgtggc

SEQ ID NO: 979343 - DNA, 25 bp, Mus musculus
ttttctcgttgccattggaatagag

SEQ ID NO: 979344 - DNA, 25 bp, Mus musculus
ttttctcgttgcgattggaatagag

SEQ ID NO: 979345 - DNA, 25 bp, Mus musculus
ttttctctaactatcagctatggaa

SEQ ID NO: 979346 - DNA, 25 bp, Mus musculus
ttttctctaactttcagctatggaa

SEQ ID NO: 979347 - DNA, 25 bp, Mus musculus
ttttctctacccctatactgtttca

SEQ ID NO: 979348 - DNA, 25 bp, Mus musculus
ttttctctacccgtatactgtttca

SEQ ID NO: 979349 - DNA, 25 bp, Mus musculus
ttttctctacctcagggatcccgga

SEQ ID NO: 979350 - DNA, 25 bp, Mus musculus
ttttctctacctgagggatcccgga

SEQ ID NO: 979351 - DNA, 25 bp, Mus musculus
ttttctctacttagccactgatggc

SEQ ID NO: 979352 - DNA, 25 bp, Mus musculus
ttttctctactttgccactgatggc

SEQ ID NO: 979353 - DNA, 25 bp, Mus musculus
ttttctctagaacgcgacacaaata

SEQ ID NO: 979354 - DNA, 25 bp, Mus musculus
ttttctctagaaggcgacacaaata

SEQ ID NO: 979355 - DNA, 25 bp, Mus musculus
ttttctctagatattcttcacttca

SEQ ID NO: 979356 - DNA, 25 bp, Mus musculus
ttttctctagattttcttcacttca

SEQ ID NO: 979357 - DNA, 25 bp, Mus musculus
ttttctctagcgcttcaaggtatgt

SEQ ID NO: 979358 - DNA, 25 bp, Mus musculus
ttttctctagcggttcaaggtatgt

SEQ ID NO: 979359 - DNA, 25 bp, Mus musculus
ttttctctagtaacttcattccgcc

SEQ ID NO: 979360 - DNA, 25 bp, Mus musculus
ttttctctagtatcttcattccgcc

SEQ ID NO: 979361 - DNA, 25 bp, Mus musculus
ttttctctagtgatgctaccatggt

SEQ ID NO: 979362 - DNA, 25 bp, Mus musculus
ttttctctagtgttgctaccatggt

SEQ ID NO: 979363 - DNA, 25 bp, Mus musculus
ttttctctatgtactcttctgataa

SEQ ID NO: 979364 - DNA, 25 bp, Mus musculus
ttttctctatgttctcttctgataa

SEQ ID NO: 979365 - DNA, 25 bp, Mus musculus
ttttctctcagactccaagcacact

SEQ ID NO: 979366 - DNA, 25 bp, Mus musculus
ttttctctcagagtccaagcacact

SEQ ID NO: 979367 - DNA, 25 bp, Mus musculus
ttttctctcattatactcttgtcag

SEQ ID NO: 979368 - DNA, 25 bp, Mus musculus
ttttctctcattttactcttgtcag

SEQ ID NO: 979369 - DNA, 25 bp, Mus musculus
ttttctctccacacatctgagataa

SEQ ID NO: 979370 - DNA, 25 bp, Mus musculus
ttttctctccactcatctgagataa

SEQ ID NO: 979371 - DNA, 25 bp, Mus musculus
ttttctctcctacctgttgtattac

SEQ ID NO: 979372 - DNA, 25 bp, Mus musculus
ttttctctcctagctgttgtattac

SEQ ID NO: 979373 - DNA, 25 bp, Mus musculus
ttttctctcctgcaattgcatctag

SEQ ID NO: 979374 - DNA, 25 bp, Mus musculus
ttttctctcctgcttccgaaatgga

SEQ ID NO: 979375 - DNA, 25 bp, Mus musculus
ttttctctcctggaattgcatctag

SEQ ID NO: 979376 - DNA, 25 bp, Mus musculus
ttttctctcctggttccgaaatgga

SEQ ID NO: 979377 - DNA, 25 bp, Mus musculus
ttttctctcgatccgatgctcatgc

SEQ ID NO: 979378 - DNA, 25 bp, Mus musculus
ttttctctcgatgcgatgctcatgc

SEQ ID NO: 979379 - DNA, 25 bp, Mus musculus
ttttctctctatataggcatgtctg

SEQ ID NO: 979380 - DNA, 25 bp, Mus musculus
ttttctctctatcgctctgatctgc

SEQ ID NO: 979381 - DNA, 25 bp, Mus musculus
ttttctctctatggctctgatctgc

SEQ ID NO: 979382 - DNA, 25 bp, Mus musculus
ttttctctctatttaggcatgtctg

SEQ ID NO: 979383 - DNA, 25 bp, Mus musculus
ttttctctctccacaaagaaatggt

SEQ ID NO: 979384 - DNA, 25 bp, Mus musculus
ttttctctctcctcaaagaaatggt

SEQ ID NO: 979385 - DNA, 25 bp, Mus musculus
ttttctctctcgaagcgcttgggaa

SEQ ID NO: 979386 - DNA, 25 bp, Mus musculus
ttttctctctcgtagcgcttgggaa

SEQ ID NO: 979387 - DNA, 25 bp, Mus musculus
ttttctctctctagacacagacaca

SEQ ID NO: 979388 - DNA, 25 bp, Mus musculus
ttttctctctcttgacacagacaca

SEQ ID NO: 979389 - DNA, 25 bp, Mus musculus
ttttctctctgcaacatttgttcct

SEQ ID NO: 979390 - DNA, 25 bp, Mus musculus
ttttctctctgctacatttgttcct

SEQ ID NO: 979391 - DNA, 25 bp, Mus musculus
ttttctctctggacttgacaataga

SEQ ID NO: 979392 - DNA, 25 bp, Mus musculus
ttttctctctggtcttgacaataga

SEQ ID NO: 979393 - DNA, 25 bp, Mus musculus
ttttctctctgtccacatgttaact

SEQ ID NO: 979394 - DNA, 25 bp, Mus musculus
ttttctctctgtgcacatgttaact

SEQ ID NO: 979395 - DNA, 25 bp, Mus musculus
ttttctctctttatccctgcacatt

SEQ ID NO: 979396 - DNA, 25 bp, Mus musculus
ttttctctctttttccctgcacatt

SEQ ID NO: 979397 - DNA, 25 bp, Mus musculus
ttttctctgagacaccgttttttgc

SEQ ID NO: 979398 - DNA, 25 bp, Mus musculus
ttttctctgagagaccgttttttgc

SEQ ID NO: 979399 - DNA, 25 bp, Mus musculus
ttttctctgaggaggcgatgtcaag

SEQ ID NO: 979400 - DNA, 25 bp, Mus musculus
ttttctctgaggtggcgatgtcaag

SEQ ID NO: 979401 - DNA, 25 bp, Mus musculus
ttttctctgctaagtgcttgtgata

SEQ ID NO: 979402 - DNA, 25 bp, Mus musculus
ttttctctgctatgtgcttgtgata

SEQ ID NO: 979403 - DNA, 25 bp, Mus musculus
ttttctctgctgaaccaaggctctg

SEQ ID NO: 979404 - DNA, 25 bp, Mus musculus
ttttctctgctgtaccaaggctctg

SEQ ID NO: 979405 - DNA, 25 bp, Mus musculus
ttttctctggagctcatcgaacgag

SEQ ID NO: 979406 - DNA, 25 bp, Mus musculus
ttttctctggaggtcatcgaacgag

SEQ ID NO: 979407 - DNA, 25 bp, Mus musculus
ttttctctggatctgtctttttgat

SEQ ID NO: 979408 - DNA, 25 bp, Mus musculus
ttttctctggatgtgtctttttgat

SEQ ID NO: 979409 - DNA, 25 bp, Mus musculus
ttttctctggccagtgagttggctc

SEQ ID NO: 979410 - DNA, 25 bp, Mus musculus
ttttctctggcctgtgagttggctc

SEQ ID NO: 979411 - DNA, 25 bp, Mus musculus
ttttctctgggcatatacttgttaa

SEQ ID NO: 979412 - DNA, 25 bp, Mus musculus
ttttctctgggcctaattcagaatc

SEQ ID NO: 979413 - DNA, 25 bp, Mus musculus
ttttctctgggcgtaattcagaatc

SEQ ID NO: 979414 - DNA, 25 bp, Mus musculus
ttttctctgggcttatacttgttaa

SEQ ID NO: 979415 - DNA, 25 bp, Mus musculus
ttttctctgggtccaaagatgttca

SEQ ID NO: 979416 - DNA, 25 bp, Mus musculus
ttttctctgggtgcaaagatgttca

SEQ ID NO: 979417 - DNA, 25 bp, Mus musculus
ttttctctgtctatagttcttcccc

SEQ ID NO: 979418 - DNA, 25 bp, Mus musculus
ttttctctgtctttagttcttcccc

SEQ ID NO: 979419 - DNA, 25 bp, Mus musculus
ttttctctgttcagatctagctgac

SEQ ID NO: 979420 - DNA, 25 bp, Mus musculus
ttttctctgttctgatctagctgac

SEQ ID NO: 979421 - DNA, 25 bp, Mus musculus
ttttctctgtttacacagccaattg

SEQ ID NO: 979422 - DNA, 25 bp, Mus musculus
ttttctctgtttcttctaccggcac

SEQ ID NO: 979423 - DNA, 25 bp, Mus musculus
ttttctctgtttgttctaccggcac

SEQ ID NO: 979424 - DNA, 25 bp, Mus musculus
ttttctctgttttcacagccaattg

SEQ ID NO: 979425 - DNA, 25 bp, Mus musculus
ttttctcttagaccatgacctccac

SEQ ID NO: 979426 - DNA, 25 bp, Mus musculus
ttttctcttagagcatgacctccac

SEQ ID NO: 979427 - DNA, 25 bp, Mus musculus
ttttctcttcacactgatactctcg

SEQ ID NO: 979428 - DNA, 25 bp, Mus musculus
ttttctcttcactctgatactctcg

SEQ ID NO: 979429 - DNA, 25 bp, Mus musculus
ttttctcttcatatctgcggcctat

SEQ ID NO: 979430 - DNA, 25 bp, Mus musculus
ttttctcttcatttctgcggcctat

SEQ ID NO: 979431 - DNA, 25 bp, Mus musculus
ttttctcttccgagtgttttggaca

SEQ ID NO: 979432 - DNA, 25 bp, Mus musculus
ttttctcttccgtgtgttttggaca

SEQ ID NO: 979433 - DNA, 25 bp, Mus musculus
ttttctcttgaaataccaggtggac

SEQ ID NO: 979434 - DNA, 25 bp, Mus musculus
ttttctcttgaattaccaggtggac

SEQ ID NO: 979435 - DNA, 25 bp, Mus musculus
ttttctcttgacagttacacacaca

SEQ ID NO: 979436 - DNA, 25 bp, Mus musculus
ttttctcttgactgttacacacaca

SEQ ID NO: 979437 - DNA, 25 bp, Mus musculus
ttttctcttgagatcctaggttagt

SEQ ID NO: 979438 - DNA, 25 bp, Mus musculus
ttttctcttgagttcctaggttagt

SEQ ID NO: 979439 - DNA, 25 bp, Mus musculus
ttttctcttgccaatgtatttttgt

SEQ ID NO: 979440 - DNA, 25 bp, Mus musculus
ttttctcttgcctatgtatttttgt

SEQ ID NO: 979441 - DNA, 25 bp, Mus musculus
ttttctcttgtcagtcactgtgatc

SEQ ID NO: 979442 - DNA, 25 bp, Mus musculus
ttttctcttgtctgtcactgtgatc

SEQ ID NO: 979443 - DNA, 25 bp, Mus musculus
ttttctctttcacttatttcacttt

SEQ ID NO: 979444 - DNA, 25 bp, Mus musculus
ttttctctttcagttatttcacttt

SEQ ID NO: 979445 - DNA, 25 bp, Mus musculus
ttttctctttgactgactttctccc

SEQ ID NO: 979446 - DNA, 25 bp, Mus musculus
ttttctctttgagtgactttctccc

SEQ ID NO: 979447 - DNA, 25 bp, Mus musculus
ttttctctttgcatccagttttaag

SEQ ID NO: 979448 - DNA, 25 bp, Mus musculus
ttttctctttgcttccagttttaag

SEQ ID NO: 979449 - DNA, 25 bp, Mus musculus
ttttctcttttcatcacgaagttgt

SEQ ID NO: 979450 - DNA, 25 bp, Mus musculus
ttttctcttttcttcacgaagttgt

SEQ ID NO: 979451 - DNA, 25 bp, Mus musculus
ttttctgaaattcctctccaaagac

SEQ ID NO: 979452 - DNA, 25 bp, Mus musculus
ttttctgaaattgctctccaaagac

SEQ ID NO: 979453 - DNA, 25 bp, Mus musculus
ttttctgaagacacaggaggattca

SEQ ID NO: 979454 - DNA, 25 bp, Mus musculus
ttttctgaagactcaggaggattca

SEQ ID NO: 979455 - DNA, 25 bp, Mus musculus
ttttctgaatcaatctatggaactt

SEQ ID NO: 979456 - DNA, 25 bp, Mus musculus
ttttctgaatcattctatggaactt

SEQ ID NO: 979457 - DNA, 25 bp, Mus musculus
ttttctgaattcaaacacttgggtg

SEQ ID NO: 979458 - DNA, 25 bp, Mus musculus
ttttctgaattctaacacttgggtg

SEQ ID NO: 979459 - DNA, 25 bp, Mus musculus
ttttctgacatgctctcttgtctga

SEQ ID NO: 979460 - DNA, 25 bp, Mus musculus
ttttctgacatggtctcttgtctga

SEQ ID NO: 979461 - DNA, 25 bp, Mus musculus
ttttctgaccacataaaggcttttt

SEQ ID NO: 979462 - DNA, 25 bp, Mus musculus
ttttctgaccacttaaaggcttttt

SEQ ID NO: 979463 - DNA, 25 bp, Mus musculus
ttttctgacctcctaaggcaggcat

SEQ ID NO: 979464 - DNA, 25 bp, Mus musculus
ttttctgacctcgtaaggcaggcat

SEQ ID NO: 979465 - DNA, 25 bp, Mus musculus
ttttctgacctgcagccgtagtggt

SEQ ID NO: 979466 - DNA, 25 bp, Mus musculus
ttttctgacctggagccgtagtggt

SEQ ID NO: 979467 - DNA, 25 bp, Mus musculus
ttttctgactggctcttctggtccc

SEQ ID NO: 979468 - DNA, 25 bp, Mus musculus
ttttctgactgggtcttctggtccc

SEQ ID NO: 979469 - DNA, 25 bp, Mus musculus
ttttctgagaggagctatgattaca

SEQ ID NO: 979470 - DNA, 25 bp, Mus musculus
ttttctgagaggtgctatgattaca

SEQ ID NO: 979471 - DNA, 25 bp, Mus musculus
ttttctgagctcatttatgcaatcc

SEQ ID NO: 979472 - DNA, 25 bp, Mus musculus
ttttctgagctcttttatgcaatcc

SEQ ID NO: 979473 - DNA, 25 bp, Mus musculus
ttttctgatccccaagggcacgatc

SEQ ID NO: 979474 - DNA, 25 bp, Mus musculus
ttttctgatcccgaagggcacgatc

SEQ ID NO: 979475 - DNA, 25 bp, Mus musculus
ttttctgatgaaacctggtggccca

SEQ ID NO: 979476 - DNA, 25 bp, Mus musculus
ttttctgatgaatcctggtggccca

SEQ ID NO: 979477 - DNA, 25 bp, Mus musculus
ttttctgattccatgtgctttatgt

SEQ ID NO: 979478 - DNA, 25 bp, Mus musculus
ttttctgattccttgtgctttatgt

SEQ ID NO: 979479 - DNA, 25 bp, Mus musculus
ttttctgattgcacctccttagtta

SEQ ID NO: 979480 - DNA, 25 bp, Mus musculus
ttttctgattgctcctccttagtta

SEQ ID NO: 979481 - DNA, 25 bp, Mus musculus
ttttctgccagaagggaggacgtcg

SEQ ID NO: 979482 - DNA, 25 bp, Mus musculus
ttttctgccagatgggaggacgtcg

SEQ ID NO: 979483 - DNA, 25 bp, Mus musculus
ttttctgccagcacctaggatccag

SEQ ID NO: 979484 - DNA, 25 bp, Mus musculus
ttttctgccagcctgcacgtggacc

SEQ ID NO: 979485 - DNA, 25 bp, Mus musculus
ttttctgccagcgtgcacgtggacc

SEQ ID NO: 979486 - DNA, 25 bp, Mus musculus
ttttctgccagctcctaggatccag

SEQ ID NO: 979487 - DNA, 25 bp, Mus musculus
ttttctgccatgatttactgtacca

SEQ ID NO: 979488 - DNA, 25 bp, Mus musculus
ttttctgccatgcaggcaagaccat

SEQ ID NO: 979489 - DNA, 25 bp, Mus musculus
ttttctgccatggaggcaagaccat

SEQ ID NO: 979490 - DNA, 25 bp, Mus musculus
ttttctgccatgttttactgtacca

SEQ ID NO: 979491 - DNA, 25 bp, Mus musculus
ttttctgccctaatgctgttctgac

SEQ ID NO: 979492 - DNA, 25 bp, Mus musculus
ttttctgccctattgctgttctgac

SEQ ID NO: 979493 - DNA, 25 bp, Mus musculus
ttttctgcccttagtgacatcacac

SEQ ID NO: 979494 - DNA, 25 bp, Mus musculus
ttttctgcccttagttgatactgca

SEQ ID NO: 979495 - DNA, 25 bp, Mus musculus
ttttctgcccttcaagcataggtgt

SEQ ID NO: 979496 - DNA, 25 bp, Mus musculus
ttttctgcccttgaagcataggtgt

SEQ ID NO: 979497 - DNA, 25 bp, Mus musculus
ttttctgccctttgtgacatcacac

SEQ ID NO: 979498 - DNA, 25 bp, Mus musculus
ttttctgccctttgttgatactgca

SEQ ID NO: 979499 - DNA, 25 bp, Mus musculus
ttttctgcctggatcgtgtagatgt

SEQ ID NO: 979500 - DNA, 25 bp, Mus musculus
ttttctgcctggttcgtgtagatgt

SEQ ID NO: 979501 - DNA, 25 bp, Mus musculus
ttttctgccttccagatgtgcattc

SEQ ID NO: 979502 - DNA, 25 bp, Mus musculus
ttttctgccttcgagatgtgcattc

SEQ ID NO: 979503 - DNA, 25 bp, Mus musculus
ttttctgctaatacaggtcctgcac

SEQ ID NO: 979504 - DNA, 25 bp, Mus musculus
ttttctgctaattcaggtcctgcac

SEQ ID NO: 979505 - DNA, 25 bp, Mus musculus
ttttctgctcttaagaatcttcaag

SEQ ID NO: 979506 - DNA, 25 bp, Mus musculus
ttttctgctcttagtgcagcgatat

SEQ ID NO: 979507 - DNA, 25 bp, Mus musculus
ttttctgctcttattcgaaatccat

SEQ ID NO: 979508 - DNA, 25 bp, Mus musculus
ttttctgctctttagaatcttcaag

SEQ ID NO: 979509 - DNA, 25 bp, Mus musculus
ttttctgctctttgtgcagcgatat

SEQ ID NO: 979510 - DNA, 25 bp, Mus musculus
ttttctgctctttttcgaaatccat

SEQ ID NO: 979511 - DNA, 25 bp, Mus musculus
ttttctgctgcgatacgaagttcct

SEQ ID NO: 979512 - DNA, 25 bp, Mus musculus
ttttctgctgcgttacgaagttcct

SEQ ID NO: 979513 - DNA, 25 bp, Mus musculus
ttttctgctggcctaagtcactgtg

SEQ ID NO: 979514 - DNA, 25 bp, Mus musculus
ttttctgctggcgtaagtcactgtg

SEQ ID NO: 979515 - DNA, 25 bp, Mus musculus
ttttctgcttaaatagatttctata

SEQ ID NO: 979516 - DNA, 25 bp, Mus musculus
ttttctgcttaattagatttctata

SEQ ID NO: 979517 - DNA, 25 bp, Mus musculus
ttttctgcttagcttaaatatgtca

SEQ ID NO: 979518 - DNA, 25 bp, Mus musculus
ttttctgcttaggttaaatatgtca

SEQ ID NO: 979519 - DNA, 25 bp, Mus musculus
ttttctgcttgacaagggtgggacc

SEQ ID NO: 979520 - DNA, 25 bp, Mus musculus
ttttctgcttgagaagggtgggacc

SEQ ID NO: 979521 - DNA, 25 bp, Mus musculus
ttttctgcttggatgtacatatctc

SEQ ID NO: 979522 - DNA, 25 bp, Mus musculus
ttttctgcttggttgtacatatctc

SEQ ID NO: 979523 - DNA, 25 bp, Mus musculus
ttttctgcttttctgttcttgctgg

SEQ ID NO: 979524 - DNA, 25 bp, Mus musculus
ttttctgcttttgtgttcttgctgg

SEQ ID NO: 979525 - DNA, 25 bp, Mus musculus
ttttctggaaccacgtgggagccct

SEQ ID NO: 979526 - DNA, 25 bp, Mus musculus
ttttctggaacctcgtgggagccct

SEQ ID NO: 979527 - DNA, 25 bp, Mus musculus
ttttctggacaaacctgagccctaa

SEQ ID NO: 979528 - DNA, 25 bp, Mus musculus
ttttctggacaatcctgagccctaa

SEQ ID NO: 979529 - DNA, 25 bp, Mus musculus
ttttctggaccccatagatgtcaat

SEQ ID NO: 979530 - DNA, 25 bp, Mus musculus
ttttctggacccgatagatgtcaat

SEQ ID NO: 979531 - DNA, 25 bp, Mus musculus
ttttctggactacaatctttcacag

SEQ ID NO: 979532 - DNA, 25 bp, Mus musculus
ttttctggactagaatctttcacag

SEQ ID NO: 979533 - DNA, 25 bp, Mus musculus
ttttctggactcagggcatgcaagc

SEQ ID NO: 979534 - DNA, 25 bp, Mus musculus
ttttctggactctgggcatgcaagc

SEQ ID NO: 979535 - DNA, 25 bp, Mus musculus
ttttctggaggaatttatgtgctaa

SEQ ID NO: 979536 - DNA, 25 bp, Mus musculus
ttttctggaggattttatgtgctaa

SEQ ID NO: 979537 - DNA, 25 bp, Mus musculus
ttttctggagtgatgcaaggcttgt

SEQ ID NO: 979538 - DNA, 25 bp, Mus musculus
ttttctggagtgttgcaaggcttgt

SEQ ID NO: 979539 - DNA, 25 bp, Mus musculus
ttttctggcaagaatgagattggaa

SEQ ID NO: 979540 - DNA, 25 bp, Mus musculus
ttttctggcaagtatgagattggaa

SEQ ID NO: 979541 - DNA, 25 bp, Mus musculus
ttttctggcatgctcctgatttcac

SEQ ID NO: 979542 - DNA, 25 bp, Mus musculus
ttttctggcatggtcctgatttcac

SEQ ID NO: 979543 - DNA, 25 bp, Mus musculus
ttttctggccagagaagccaagaaa

SEQ ID NO: 979544 - DNA, 25 bp, Mus musculus
ttttctggccagtgaagccaagaaa

SEQ ID NO: 979545 - DNA, 25 bp, Mus musculus
ttttctggcctcatggtgaatctca

SEQ ID NO: 979546 - DNA, 25 bp, Mus musculus
ttttctggcctcttggtgaatctca

SEQ ID NO: 979547 - DNA, 25 bp, Mus musculus
ttttctggctcgaatgctccttttt

SEQ ID NO: 979548 - DNA, 25 bp, Mus musculus
ttttctggctcgtatgctccttttt

SEQ ID NO: 979549 - DNA, 25 bp, Mus musculus
ttttctgggatcaacatgactgaca

SEQ ID NO: 979550 - DNA, 25 bp, Mus musculus
ttttctgggatctacatgactgaca

SEQ ID NO: 979551 - DNA, 25 bp, Mus musculus
ttttctgggttcaatttgtcatttt

SEQ ID NO: 979552 - DNA, 25 bp, Mus musculus
ttttctgggttctatttgtcatttt

SEQ ID NO: 979553 - DNA, 25 bp, Mus musculus
ttttctgggttgataaggactcgag

SEQ ID NO: 979554 - DNA, 25 bp, Mus musculus
ttttctgggttgttaaggactcgag

SEQ ID NO: 979555 - DNA, 25 bp, Mus musculus
ttttctggtagtagggagtagctca

SEQ ID NO: 979556 - DNA, 25 bp, Mus musculus
ttttctggtagttgggagtagctca

SEQ ID NO: 979557 - DNA, 25 bp, Mus musculus
ttttctggtcctaaaatctactagt

SEQ ID NO: 979558 - DNA, 25 bp, Mus musculus
ttttctggtccttaaatctactagt

SEQ ID NO: 979559 - DNA, 25 bp, Mus musculus
ttttctggtgacacacccggccaga

SEQ ID NO: 979560 - DNA, 25 bp, Mus musculus
ttttctggtgactcacccggccaga

SEQ ID NO: 979561 - DNA, 25 bp, Mus musculus
ttttctggtggactgtgcggatcat

SEQ ID NO: 979562 - DNA, 25 bp, Mus musculus
ttttctggtggagtgtgcggatcat

SEQ ID NO: 979563 - DNA, 25 bp, Mus musculus
ttttctggtgtactactaaggtctt

SEQ ID NO: 979564 - DNA, 25 bp, Mus musculus
ttttctggtgtagtactaaggtctt

SEQ ID NO: 979565 - DNA, 25 bp, Mus musculus
ttttctggtgttatgtgtttctcta

SEQ ID NO: 979566 - DNA, 25 bp, Mus musculus
ttttctggtgttttgtgtttctcta

SEQ ID NO: 979567 - DNA, 25 bp, Mus musculus
ttttctggttctcagtaatgggcgg

SEQ ID NO: 979568 - DNA, 25 bp, Mus musculus
ttttctggttctgagtaatgggcgg

SEQ ID NO: 979569 - DNA, 25 bp, Mus musculus
ttttctgtaaacctctctcatttct

SEQ ID NO: 979570 - DNA, 25 bp, Mus musculus
ttttctgtaaacgtctctcatttct

SEQ ID NO: 979571 - DNA, 25 bp, Mus musculus
ttttctgtaaggaataattcatggg

SEQ ID NO: 979572 - DNA, 25 bp, Mus musculus
ttttctgtaaggtataattcatggg

SEQ ID NO: 979573 - DNA, 25 bp, Mus musculus
ttttctgtaccgatccctgttggca

SEQ ID NO: 979574 - DNA, 25 bp, Mus musculus
ttttctgtaccgttccctgttggca

SEQ ID NO: 979575 - DNA, 25 bp, Mus musculus
ttttctgtacgtactttttcaagat

SEQ ID NO: 979576 - DNA, 25 bp, Mus musculus
ttttctgtacgttctttttcaagat

SEQ ID NO: 979577 - DNA, 25 bp, Mus musculus
ttttctgtactaattgcatccccaa

SEQ ID NO: 979578 - DNA, 25 bp, Mus musculus
ttttctgtactatttgcatccccaa

SEQ ID NO: 979579 - DNA, 25 bp, Mus musculus
ttttctgtagcccttggatcataat

SEQ ID NO: 979580 - DNA, 25 bp, Mus musculus
ttttctgtagccgttggatcataat

SEQ ID NO: 979581 - DNA, 25 bp, Mus musculus
ttttctgtagtaagccaggcttccc

SEQ ID NO: 979582 - DNA, 25 bp, Mus musculus
ttttctgtagtaattgcaccaatga

SEQ ID NO: 979583 - DNA, 25 bp, Mus musculus
ttttctgtagtatgccaggcttccc

SEQ ID NO: 979584 - DNA, 25 bp, Mus musculus
ttttctgtagtatttgcaccaatga

SEQ ID NO: 979585 - DNA, 25 bp, Mus musculus
ttttctgtcataaaccttggagtct

SEQ ID NO: 979586 - DNA, 25 bp, Mus musculus
ttttctgtcatataccttggagtct

SEQ ID NO: 979587 - DNA, 25 bp, Mus musculus
ttttctgtcattagcggagttcgcg

SEQ ID NO: 979588 - DNA, 25 bp, Mus musculus
ttttctgtcatttgcggagttcgcg

SEQ ID NO: 979589 - DNA, 25 bp, Mus musculus
ttttctgtccatcgaccaagtccag

SEQ ID NO: 979590 - DNA, 25 bp, Mus musculus
ttttctgtccatggaccaagtccag

SEQ ID NO: 979591 - DNA, 25 bp, Mus musculus
ttttctgtcccacgagggtaaggca

SEQ ID NO: 979592 - DNA, 25 bp, Mus musculus
ttttctgtcccaggagggtaaggca

SEQ ID NO: 979593 - DNA, 25 bp, Mus musculus
ttttctgtccctaatcgtgtggtaa

SEQ ID NO: 979594 - DNA, 25 bp, Mus musculus
ttttctgtcccttatcgtgtggtaa

SEQ ID NO: 979595 - DNA, 25 bp, Mus musculus
ttttctgtcctgacttagcatcctt

SEQ ID NO: 979596 - DNA, 25 bp, Mus musculus
ttttctgtcctgtcttagcatcctt

SEQ ID NO: 979597 - DNA, 25 bp, Mus musculus
ttttctgtccttaatctgactgctt

SEQ ID NO: 979598 - DNA, 25 bp, Mus musculus
ttttctgtcctttatctgactgctt

SEQ ID NO: 979599 - DNA, 25 bp, Mus musculus
ttttctgtcggtcgtgtgcatgaac

SEQ ID NO: 979600 - DNA, 25 bp, Mus musculus
ttttctgtcggtggtgtgcatgaac

SEQ ID NO: 979601 - DNA, 25 bp, Mus musculus
ttttctgtctacagcttttacacaa

SEQ ID NO: 979602 - DNA, 25 bp, Mus musculus
ttttctgtctactgcttttacacaa

SEQ ID NO: 979603 - DNA, 25 bp, Mus musculus
ttttctgtctatatagctggtgaac

SEQ ID NO: 979604 - DNA, 25 bp, Mus musculus
ttttctgtctatttagctggtgaac

SEQ ID NO: 979605 - DNA, 25 bp, Mus musculus
ttttctgtctcaaaatcactcagga

SEQ ID NO: 979606 - DNA, 25 bp, Mus musculus
ttttctgtctcataatcactcagga

SEQ ID NO: 979607 - DNA, 25 bp, Mus musculus
ttttctgtctggctgatagccttgt

SEQ ID NO: 979608 - DNA, 25 bp, Mus musculus
ttttctgtctgggtgatagccttgt

SEQ ID NO: 979609 - DNA, 25 bp, Mus musculus
ttttctgtcttaatggtatcctact

SEQ ID NO: 979610 - DNA, 25 bp, Mus musculus
ttttctgtcttattggtatcctact

SEQ ID NO: 979611 - DNA, 25 bp, Mus musculus
ttttctgtgaaactggcttactcta

SEQ ID NO: 979612 - DNA, 25 bp, Mus musculus
ttttctgtgaaagtggcttactcta

SEQ ID NO: 979613 - DNA, 25 bp, Mus musculus
ttttctgtgacaattacgtctcatg

SEQ ID NO: 979614 - DNA, 25 bp, Mus musculus
ttttctgtgacatttacgtctcatg

SEQ ID NO: 979615 - DNA, 25 bp, Mus musculus
ttttctgtgctaactagttttaggg

SEQ ID NO: 979616 - DNA, 25 bp, Mus musculus
ttttctgtgctatctagttttaggg

SEQ ID NO: 979617 - DNA, 25 bp, Mus musculus
ttttctgtgcttctcggttagacat

SEQ ID NO: 979618 - DNA, 25 bp, Mus musculus
ttttctgtgcttgtcggttagacat

SEQ ID NO: 979619 - DNA, 25 bp, Mus musculus
ttttctgtggaacctcagcatcatt

SEQ ID NO: 979620 - DNA, 25 bp, Mus musculus
ttttctgtggaagctcagcatcatt

SEQ ID NO: 979621 - DNA, 25 bp, Mus musculus
ttttctgtgggaacgaggtgaataa

SEQ ID NO: 979622 - DNA, 25 bp, Mus musculus
ttttctgtgggatcgaggtgaataa

SEQ ID NO: 979623 - DNA, 25 bp, Mus musculus
ttttctgtggttaaaaggctgttct

SEQ ID NO: 979624 - DNA, 25 bp, Mus musculus
ttttctgtggtttaaaggctgttct

SEQ ID NO: 979625 - DNA, 25 bp, Mus musculus
ttttctgtgtgtaaccttagtgtca

SEQ ID NO: 979626 - DNA, 25 bp, Mus musculus
ttttctgtgtgttaccttagtgtca

SEQ ID NO: 979627 - DNA, 25 bp, Mus musculus
ttttctgtgtttaaggtcctactct

SEQ ID NO: 979628 - DNA, 25 bp, Mus musculus
ttttctgtgttttaggtcctactct

SEQ ID NO: 979629 - DNA, 25 bp, Mus musculus
ttttctgttattccatgactattcc

SEQ ID NO: 979630 - DNA, 25 bp, Mus musculus
ttttctgttattgcatgactattcc

SEQ ID NO: 979631 - DNA, 25 bp, Mus musculus
ttttctgttccaaatgccctacttg

SEQ ID NO: 979632 - DNA, 25 bp, Mus musculus
ttttctgttccatatgccctacttg

SEQ ID NO: 979633 - DNA, 25 bp, Mus musculus
ttttctgttgggaaccttgcaatgc

SEQ ID NO: 979634 - DNA, 25 bp, Mus musculus
ttttctgttgggtaccttgcaatgc

SEQ ID NO: 979635 - DNA, 25 bp, Mus musculus
ttttctgttgtgctccaggccagga

SEQ ID NO: 979636 - DNA, 25 bp, Mus musculus
ttttctgttgtggtccaggccagga

SEQ ID NO: 979637 - DNA, 25 bp, Mus musculus
ttttctgttgttagtttgcctaatt

SEQ ID NO: 979638 - DNA, 25 bp, Mus musculus
ttttctgttgttcatgtgatagcca

SEQ ID NO: 979639 - DNA, 25 bp, Mus musculus
ttttctgttgttgatgtgatagcca

SEQ ID NO: 979640 - DNA, 25 bp, Mus musculus
ttttctgttgtttgtttgcctaatt

SEQ ID NO: 979641 - DNA, 25 bp, Mus musculus
ttttctgtttgaccatgttatattc

SEQ ID NO: 979642 - DNA, 25 bp, Mus musculus
ttttctgtttgagcatgttatattc

SEQ ID NO: 979643 - DNA, 25 bp, Mus musculus
ttttctgttttacagccaggcagct

SEQ ID NO: 979644 - DNA, 25 bp, Mus musculus
ttttctgttttagagccaggcagct

SEQ ID NO: 979645 - DNA, 25 bp, Mus musculus
ttttctgttttcagaccattctctt

SEQ ID NO: 979646 - DNA, 25 bp, Mus musculus
ttttctgttttcctcagcatccttt

SEQ ID NO: 979647 - DNA, 25 bp, Mus musculus
ttttctgttttcgtcagcatccttt

SEQ ID NO: 979648 - DNA, 25 bp, Mus musculus
ttttctgttttctgaccattctctt

SEQ ID NO: 979649 - DNA, 25 bp, Mus musculus
ttttcttaaagacaatgccgctagc

SEQ ID NO: 979650 - DNA, 25 bp, Mus musculus
ttttcttaaagagaatgccgctagc

SEQ ID NO: 979651 - DNA, 25 bp, Mus musculus
ttttcttaacctcagtgcttttcct

SEQ ID NO: 979652 - DNA, 25 bp, Mus musculus
ttttcttaacctgagtgcttttcct

SEQ ID NO: 979653 - DNA, 25 bp, Mus musculus
ttttcttaagcccaggcagcacttt

SEQ ID NO: 979654 - DNA, 25 bp, Mus musculus
ttttcttaagccgaggcagcacttt

SEQ ID NO: 979655 - DNA, 25 bp, Mus musculus
ttttcttacagtcacagtaccctta

SEQ ID NO: 979656 - DNA, 25 bp, Mus musculus
ttttcttacagtgacagtaccctta

SEQ ID NO: 979657 - DNA, 25 bp, Mus musculus
ttttcttacatgcttagcacagatt

SEQ ID NO: 979658 - DNA, 25 bp, Mus musculus
ttttcttacatggttagcacagatt

SEQ ID NO: 979659 - DNA, 25 bp, Mus musculus
ttttcttaccgtactcttaatacat

SEQ ID NO: 979660 - DNA, 25 bp, Mus musculus
ttttcttaccgttctcttaatacat

SEQ ID NO: 979661 - DNA, 25 bp, Mus musculus
ttttcttactctcccctttcatcat

SEQ ID NO: 979662 - DNA, 25 bp, Mus musculus
ttttcttactctgccctttcatcat

SEQ ID NO: 979663 - DNA, 25 bp, Mus musculus
ttttcttagatcacagccaaggctt

SEQ ID NO: 979664 - DNA, 25 bp, Mus musculus
ttttcttagatctcagccaaggctt

SEQ ID NO: 979665 - DNA, 25 bp, Mus musculus
ttttcttagcccatgctatgctcta

SEQ ID NO: 979666 - DNA, 25 bp, Mus musculus
ttttcttagcccttgctatgctcta

SEQ ID NO: 979667 - DNA, 25 bp, Mus musculus
ttttcttaggaacagtctcccctct

SEQ ID NO: 979668 - DNA, 25 bp, Mus musculus
ttttcttaggaagagtctcccctct

SEQ ID NO: 979669 - DNA, 25 bp, Mus musculus
ttttcttagggacagtttacaatag

SEQ ID NO: 979670 - DNA, 25 bp, Mus musculus
ttttcttagggagagtttacaatag

SEQ ID NO: 979671 - DNA, 25 bp, Mus musculus
ttttcttagtagcttgcccaccagg

SEQ ID NO: 979672 - DNA, 25 bp, Mus musculus
ttttcttagtaggttgcccaccagg

SEQ ID NO: 979673 - DNA, 25 bp, Mus musculus
ttttcttagtgaagtgtgttgcttt

SEQ ID NO: 979674 - DNA, 25 bp, Mus musculus
ttttcttagtgatgtgtgttgcttt

SEQ ID NO: 979675 - DNA, 25 bp, Mus musculus
ttttcttatacaatgcagtcacccc

SEQ ID NO: 979676 - DNA, 25 bp, Mus musculus
ttttcttatacattgcagtcacccc

SEQ ID NO: 979677 - DNA, 25 bp, Mus musculus
ttttcttatcctctattctttcaga

SEQ ID NO: 979678 - DNA, 25 bp, Mus musculus
ttttcttatcctgtattctttcaga

SEQ ID NO: 979679 - DNA, 25 bp, Mus musculus
ttttcttatgtcatacaggtgactt

SEQ ID NO: 979680 - DNA, 25 bp, Mus musculus
ttttcttatgtcttacaggtgactt

SEQ ID NO: 979681 - DNA, 25 bp, Mus musculus
ttttcttatgtgacgtgcctttgag

SEQ ID NO: 979682 - DNA, 25 bp, Mus musculus
ttttcttatgtgtcgtgcctttgag

SEQ ID NO: 979683 - DNA, 25 bp, Mus musculus
ttttcttcaactagactaaatgcca

SEQ ID NO: 979684 - DNA, 25 bp, Mus musculus
ttttcttcaacttgactaaatgcca

SEQ ID NO: 979685 - DNA, 25 bp, Mus musculus
ttttcttcaataagtagcaactaca

SEQ ID NO: 979686 - DNA, 25 bp, Mus musculus
ttttcttcaatatgtagcaactaca

SEQ ID NO: 979687 - DNA, 25 bp, Mus musculus
ttttcttcaccaactgtactgctca

SEQ ID NO: 979688 - DNA, 25 bp, Mus musculus
ttttcttcaccatctgtactgctca

SEQ ID NO: 979689 - DNA, 25 bp, Mus musculus
ttttcttcaccccttgagcgaagtg

SEQ ID NO: 979690 - DNA, 25 bp, Mus musculus
ttttcttcacccgttgagcgaagtg

SEQ ID NO: 979691 - DNA, 25 bp, Mus musculus
ttttcttcacggccaggacccactg

SEQ ID NO: 979692 - DNA, 25 bp, Mus musculus
ttttcttcacgggcaggacccactg

SEQ ID NO: 979693 - DNA, 25 bp, Mus musculus
ttttcttcacgtatggacctgtgct

SEQ ID NO: 979694 - DNA, 25 bp, Mus musculus
ttttcttcacgtttggacctgtgct

SEQ ID NO: 979695 - DNA, 25 bp, Mus musculus
ttttcttcactacccttatgcaaaa

SEQ ID NO: 979696 - DNA, 25 bp, Mus musculus
ttttcttcactagccttatgcaaaa

SEQ ID NO: 979697 - DNA, 25 bp, Mus musculus
ttttcttcactcaggttggctggtt

SEQ ID NO: 979698 - DNA, 25 bp, Mus musculus
ttttcttcactctggttggctggtt

SEQ ID NO: 979699 - DNA, 25 bp, Mus musculus
ttttcttcagagactttccccaaca

SEQ ID NO: 979700 - DNA, 25 bp, Mus musculus
ttttcttcagagtctttccccaaca

SEQ ID NO: 979701 - DNA, 25 bp, Mus musculus
ttttcttcagatcagggcagaacca

SEQ ID NO: 979702 - DNA, 25 bp, Mus musculus
ttttcttcagatgagggcagaacca

SEQ ID NO: 979703 - DNA, 25 bp, Mus musculus
ttttcttcagcaagtacaccatgtc

SEQ ID NO: 979704 - DNA, 25 bp, Mus musculus
ttttcttcagcatgtacaccatgtc

SEQ ID NO: 979705 - DNA, 25 bp, Mus musculus
ttttcttcagtacctgcctcacaga

SEQ ID NO: 979706 - DNA, 25 bp, Mus musculus
ttttcttcagtagctgcctcacaga

SEQ ID NO: 979707 - DNA, 25 bp, Mus musculus
ttttcttcatatcggcagttgtact

SEQ ID NO: 979708 - DNA, 25 bp, Mus musculus
ttttcttcatatgggcagttgtact

SEQ ID NO: 979709 - DNA, 25 bp, Mus musculus
ttttcttcatctaaggagacctcag

SEQ ID NO: 979710 - DNA, 25 bp, Mus musculus
ttttcttcatcttaggagacctcag

SEQ ID NO: 979711 - DNA, 25 bp, Mus musculus
ttttcttcatgtatccgtttacaca

SEQ ID NO: 979712 - DNA, 25 bp, Mus musculus
ttttcttcatgtttccgtttacaca

SEQ ID NO: 979713 - DNA, 25 bp, Mus musculus
ttttcttccactcgtcattttccta

SEQ ID NO: 979714 - DNA, 25 bp, Mus musculus
ttttcttccactggtcattttccta

SEQ ID NO: 979715 - DNA, 25 bp, Mus musculus
ttttcttccagaaatccctctctac

SEQ ID NO: 979716 - DNA, 25 bp, Mus musculus
ttttcttccagatatccctctctac

SEQ ID NO: 979717 - DNA, 25 bp, Mus musculus
ttttcttcccagaagtctatgacaa

SEQ ID NO: 979718 - DNA, 25 bp, Mus musculus
ttttcttcccagacactattctgac

SEQ ID NO: 979719 - DNA, 25 bp, Mus musculus
ttttcttcccagtagtctatgacaa

SEQ ID NO: 979720 - DNA, 25 bp, Mus musculus
ttttcttcccagtcactattctgac

SEQ ID NO: 979721 - DNA, 25 bp, Mus musculus
ttttcttcccatattggcttctgca

SEQ ID NO: 979722 - DNA, 25 bp, Mus musculus
ttttcttcccattttggcttctgca

SEQ ID NO: 979723 - DNA, 25 bp, Mus musculus
ttttcttcccctaatcttcctgatt

SEQ ID NO: 979724 - DNA, 25 bp, Mus musculus
ttttcttccccttatcttcctgatt

SEQ ID NO: 979725 - DNA, 25 bp, Mus musculus
ttttcttccctactactaaccatgg

SEQ ID NO: 979726 - DNA, 25 bp, Mus musculus
ttttcttccctagtactaaccatgg

SEQ ID NO: 979727 - DNA, 25 bp, Mus musculus
ttttcttccctgatacctgcttaat

SEQ ID NO: 979728 - DNA, 25 bp, Mus musculus
ttttcttccctgttacctgcttaat

SEQ ID NO: 979729 - DNA, 25 bp, Mus musculus
ttttcttcctagaatttggaggcct

SEQ ID NO: 979730 - DNA, 25 bp, Mus musculus
ttttcttcctagtatttggaggcct

SEQ ID NO: 979731 - DNA, 25 bp, Mus musculus
ttttcttcctccatgtaggccctaa

SEQ ID NO: 979732 - DNA, 25 bp, Mus musculus
ttttcttcctccttgtaggccctaa

SEQ ID NO: 979733 - DNA, 25 bp, Mus musculus
ttttcttcctctcaaccatgatgca

SEQ ID NO: 979734 - DNA, 25 bp, Mus musculus
ttttcttcctctgaaccatgatgca

SEQ ID NO: 979735 - DNA, 25 bp, Mus musculus
ttttcttcctgcaatatcttctgta

SEQ ID NO: 979736 - DNA, 25 bp, Mus musculus
ttttcttcctgctatatcttctgta

SEQ ID NO: 979737 - DNA, 25 bp, Mus musculus
ttttcttcctgtctgccacatggaa

SEQ ID NO: 979738 - DNA, 25 bp, Mus musculus
ttttcttcctgtgtgccacatggaa

SEQ ID NO: 979739 - DNA, 25 bp, Mus musculus
ttttcttccttgatgagctgaacgc

SEQ ID NO: 979740 - DNA, 25 bp, Mus musculus
ttttcttccttgttgagctgaacgc

SEQ ID NO: 979741 - DNA, 25 bp, Mus musculus
ttttcttcggcaagtgtgtgagcgt

SEQ ID NO: 979742 - DNA, 25 bp, Mus musculus
ttttcttcggcatgtgtgtgagcgt

SEQ ID NO: 979743 - DNA, 25 bp, Mus musculus
ttttcttctcataggtgtcacagaa

SEQ ID NO: 979744 - DNA, 25 bp, Mus musculus
ttttcttctcattggtgtcacagaa

SEQ ID NO: 979745 - DNA, 25 bp, Mus musculus
ttttcttctccccatcaggtataaa

SEQ ID NO: 979746 - DNA, 25 bp, Mus musculus
ttttcttctcccgatcaggtataaa

SEQ ID NO: 979747 - DNA, 25 bp, Mus musculus
ttttcttctcctctttcagatgctg

SEQ ID NO: 979748 - DNA, 25 bp, Mus musculus
ttttcttctcctgtttcagatgctg

SEQ ID NO: 979749 - DNA, 25 bp, Mus musculus
ttttcttctcgtattatactcccag

SEQ ID NO: 979750 - DNA, 25 bp, Mus musculus
ttttcttctcgttttatactcccag

SEQ ID NO: 979751 - DNA, 25 bp, Mus musculus
ttttcttctgaaaactgcccatgcc

SEQ ID NO: 979752 - DNA, 25 bp, Mus musculus
ttttcttctgaaactctgggctgag

SEQ ID NO: 979753 - DNA, 25 bp, Mus musculus
ttttcttctgaatactgcccatgcc

SEQ ID NO: 979754 - DNA, 25 bp, Mus musculus
ttttcttctgaatctctgggctgag

SEQ ID NO: 979755 - DNA, 25 bp, Mus musculus
ttttcttctgggaggtggccttcac

SEQ ID NO: 979756 - DNA, 25 bp, Mus musculus
ttttcttctgggtggtggccttcac

SEQ ID NO: 979757 - DNA, 25 bp, Mus musculus
ttttcttctgtcatggtgtcagtga

SEQ ID NO: 979758 - DNA, 25 bp, Mus musculus
ttttcttctgtcttggtgtcagtga

SEQ ID NO: 979759 - DNA, 25 bp, Mus musculus
ttttcttcttcactctcagcacata

SEQ ID NO: 979760 - DNA, 25 bp, Mus musculus
ttttcttcttcagtctcagcacata

SEQ ID NO: 979761 - DNA, 25 bp, Mus musculus
ttttcttcttccaattctacaaatt

SEQ ID NO: 979762 - DNA, 25 bp, Mus musculus
ttttcttcttccctagaacgtcaag

SEQ ID NO: 979763 - DNA, 25 bp, Mus musculus
ttttcttcttccgtagaacgtcaag

SEQ ID NO: 979764 - DNA, 25 bp, Mus musculus
ttttcttcttcctattctacaaatt

SEQ ID NO: 979765 - DNA, 25 bp, Mus musculus
ttttcttcttctccctcattgtgtg

SEQ ID NO: 979766 - DNA, 25 bp, Mus musculus
ttttcttcttctgcctcattgtgtg

SEQ ID NO: 979767 - DNA, 25 bp, Mus musculus
ttttcttgaccacagtgccctggtt

SEQ ID NO: 979768 - DNA, 25 bp, Mus musculus
ttttcttgaccagagtgccctggtt

SEQ ID NO: 979769 - DNA, 25 bp, Mus musculus
ttttcttgatacattccacacccct

SEQ ID NO: 979770 - DNA, 25 bp, Mus musculus
ttttcttgatactttccacacccct

SEQ ID NO: 979771 - DNA, 25 bp, Mus musculus
ttttcttgcattaaaattcctccag

SEQ ID NO: 979772 - DNA, 25 bp, Mus musculus
ttttcttgcatttaaattcctccag

SEQ ID NO: 979773 - DNA, 25 bp, Mus musculus
ttttcttgccagattttcacgggaa

SEQ ID NO: 979774 - DNA, 25 bp, Mus musculus
ttttcttgccagtttttcacgggaa

SEQ ID NO: 979775 - DNA, 25 bp, Mus musculus
ttttcttgcctgacctgcaggaggt

SEQ ID NO: 979776 - DNA, 25 bp, Mus musculus
ttttcttgcctgtcctgcaggaggt

SEQ ID NO: 979777 - DNA, 25 bp, Mus musculus
ttttcttgcgtgatcaggttgcgga

SEQ ID NO: 979778 - DNA, 25 bp, Mus musculus
ttttcttgcgtgttcaggttgcgga

SEQ ID NO: 979779 - DNA, 25 bp, Mus musculus
ttttcttgctgtctttacttactag

SEQ ID NO: 979780 - DNA, 25 bp, Mus musculus
ttttcttgctgtgtttacttactag

SEQ ID NO: 979781 - DNA, 25 bp, Mus musculus
ttttcttgcttgcttcgtcatagac

SEQ ID NO: 979782 - DNA, 25 bp, Mus musculus
ttttcttgcttggttcgtcatagac

SEQ ID NO: 979783 - DNA, 25 bp, Mus musculus
ttttcttggctgaacatgaccggtt

SEQ ID NO: 979784 - DNA, 25 bp, Mus musculus
ttttcttggctgcaaccttcttggc

SEQ ID NO: 979785 - DNA, 25 bp, Mus musculus
ttttcttggctgcatttaggctgct

SEQ ID NO: 979786 - DNA, 25 bp, Mus musculus
ttttcttggctggaaccttcttggc

SEQ ID NO: 979787 - DNA, 25 bp, Mus musculus
ttttcttggctggatttaggctgct

SEQ ID NO: 979788 - DNA, 25 bp, Mus musculus
ttttcttggctgtacatgaccggtt

SEQ ID NO: 979789 - DNA, 25 bp, Mus musculus
ttttcttgggcaccggagtctagct

SEQ ID NO: 979790 - DNA, 25 bp, Mus musculus
ttttcttgggcagcggagtctagct

SEQ ID NO: 979791 - DNA, 25 bp, Mus musculus
ttttcttgtaagaaggctgcccact

SEQ ID NO: 979792 - DNA, 25 bp, Mus musculus
ttttcttgtaagatgtgcatagcac

SEQ ID NO: 979793 - DNA, 25 bp, Mus musculus
ttttcttgtaagtaggctgcccact

SEQ ID NO: 979794 - DNA, 25 bp, Mus musculus
ttttcttgtaagttgtgcatagcac

SEQ ID NO: 979795 - DNA, 25 bp, Mus musculus
ttttcttgtccaatcacaggtctgc

SEQ ID NO: 979796 - DNA, 25 bp, Mus musculus
ttttcttgtccattcacaggtctgc

SEQ ID NO: 979797 - DNA, 25 bp, Mus musculus
ttttcttgtccccatcttcaaatgc

SEQ ID NO: 979798 - DNA, 25 bp, Mus musculus
ttttcttgtcccgatcttcaaatgc

SEQ ID NO: 979799 - DNA, 25 bp, Mus musculus
ttttcttgtcttattgcctgaccac

SEQ ID NO: 979800 - DNA, 25 bp, Mus musculus
ttttcttgtctttttgcctgaccac

SEQ ID NO: 979801 - DNA, 25 bp, Mus musculus
ttttcttgtgatatgttttcggcat

SEQ ID NO: 979802 - DNA, 25 bp, Mus musculus
ttttcttgtgatttgttttcggcat

SEQ ID NO: 979803 - DNA, 25 bp, Mus musculus
ttttcttgttgcccatctgtgctaa

SEQ ID NO: 979804 - DNA, 25 bp, Mus musculus
ttttcttgttgcgcatctgtgctaa

SEQ ID NO: 979805 - DNA, 25 bp, Mus musculus
ttttcttgtttaactagccgttcgc

SEQ ID NO: 979806 - DNA, 25 bp, Mus musculus
ttttcttgtttatctagccgttcgc

SEQ ID NO: 979807 - DNA, 25 bp, Mus musculus
ttttctttaaacatgctggccaggg

SEQ ID NO: 979808 - DNA, 25 bp, Mus musculus
ttttctttaaacatggctgtgtgga

SEQ ID NO: 979809 - DNA, 25 bp, Mus musculus
ttttctttaaacttgctggccaggg

SEQ ID NO: 979810 - DNA, 25 bp, Mus musculus
ttttctttaaacttggctgtgtgga

SEQ ID NO: 979811 - DNA, 25 bp, Mus musculus
ttttctttaagacgcacgaggctgc

SEQ ID NO: 979812 - DNA, 25 bp, Mus musculus
ttttctttaagaggcacgaggctgc

SEQ ID NO: 979813 - DNA, 25 bp, Mus musculus
ttttctttaattaggctattactgt

SEQ ID NO: 979814 - DNA, 25 bp, Mus musculus
ttttctttaatttggctattactgt

SEQ ID NO: 979815 - DNA, 25 bp, Mus musculus
ttttctttacatctgctccctggaa

SEQ ID NO: 979816 - DNA, 25 bp, Mus musculus
ttttctttacatgtgctccctggaa

SEQ ID NO: 979817 - DNA, 25 bp, Mus musculus
ttttctttagctctttcaatgagat

SEQ ID NO: 979818 - DNA, 25 bp, Mus musculus
ttttctttagctgtttcaatgagat

SEQ ID NO: 979819 - DNA, 25 bp, Mus musculus
ttttctttagggacatgacctttgg

SEQ ID NO: 979820 - DNA, 25 bp, Mus musculus
ttttctttagggtcatgacctttgg

SEQ ID NO: 979821 - DNA, 25 bp, Mus musculus
ttttctttatatagagggtctctct

SEQ ID NO: 979822 - DNA, 25 bp, Mus musculus
ttttctttatattgagggtctctct

SEQ ID NO: 979823 - DNA, 25 bp, Mus musculus
ttttctttattacttcagcccatga

SEQ ID NO: 979824 - DNA, 25 bp, Mus musculus
ttttctttattagttcagcccatga

SEQ ID NO: 979825 - DNA, 25 bp, Mus musculus
ttttctttattccattgaaataaca

SEQ ID NO: 979826 - DNA, 25 bp, Mus musculus
ttttctttattcgattgaaataaca

SEQ ID NO: 979827 - DNA, 25 bp, Mus musculus
ttttctttcacaattaggccattct

SEQ ID NO: 979828 - DNA, 25 bp, Mus musculus
ttttctttcacatttaggccattct

SEQ ID NO: 979829 - DNA, 25 bp, Mus musculus
ttttctttcactagctcattctttc

SEQ ID NO: 979830 - DNA, 25 bp, Mus musculus
ttttctttcacttgctcattctttc

SEQ ID NO: 979831 - DNA, 25 bp, Mus musculus
ttttctttcagaacaacaacccctc

SEQ ID NO: 979832 - DNA, 25 bp, Mus musculus
ttttctttcagatcaacaacccctc

SEQ ID NO: 979833 - DNA, 25 bp, Mus musculus
ttttctttcagtagttaaccaccag

SEQ ID NO: 979834 - DNA, 25 bp, Mus musculus
ttttctttcagttgttaaccaccag

SEQ ID NO: 979835 - DNA, 25 bp, Mus musculus
ttttctttcataagccccttgtagg

SEQ ID NO: 979836 - DNA, 25 bp, Mus musculus
ttttctttcatatgccccttgtagg

SEQ ID NO: 979837 - DNA, 25 bp, Mus musculus
ttttctttccacacagagccttaag

SEQ ID NO: 979838 - DNA, 25 bp, Mus musculus
ttttctttccactcagagccttaag

SEQ ID NO: 979839 - DNA, 25 bp, Mus musculus
ttttctttccccatggagccaagat

SEQ ID NO: 979840 - DNA, 25 bp, Mus musculus
ttttctttccccttggagccaagat

SEQ ID NO: 979841 - DNA, 25 bp, Mus musculus
ttttctttcctaactgagagtgcag

SEQ ID NO: 979842 - DNA, 25 bp, Mus musculus
ttttctttcctatctgagagtgcag

SEQ ID NO: 979843 - DNA, 25 bp, Mus musculus
ttttctttcctcctgtagctggagc

SEQ ID NO: 979844 - DNA, 25 bp, Mus musculus
ttttctttcctcgtgtagctggagc

SEQ ID NO: 979845 - DNA, 25 bp, Mus musculus
ttttctttccttatgtactgtacag

SEQ ID NO: 979846 - DNA, 25 bp, Mus musculus
ttttctttccttctgggcttgggag

SEQ ID NO: 979847 - DNA, 25 bp, Mus musculus
ttttctttccttgtgggcttgggag

SEQ ID NO: 979848 - DNA, 25 bp, Mus musculus
ttttctttccttttgtactgtacag

SEQ ID NO: 979849 - DNA, 25 bp, Mus musculus
ttttctttcgtgagttcctgagtgg

SEQ ID NO: 979850 - DNA, 25 bp, Mus musculus
ttttctttcgtgtgttcctgagtgg

SEQ ID NO: 979851 - DNA, 25 bp, Mus musculus
ttttctttctcacccggcgtacaga

SEQ ID NO: 979852 - DNA, 25 bp, Mus musculus
ttttctttctcagccggcgtacaga

SEQ ID NO: 979853 - DNA, 25 bp, Mus musculus
ttttctttctctagactcctccttt

SEQ ID NO: 979854 - DNA, 25 bp, Mus musculus
ttttctttctcttgactcctccttt

SEQ ID NO: 979855 - DNA, 25 bp, Mus musculus
ttttctttctgcattaagccccact

SEQ ID NO: 979856 - DNA, 25 bp, Mus musculus
ttttctttctgctttaagccccact

SEQ ID NO: 979857 - DNA, 25 bp, Mus musculus
ttttctttcttcagagcagccactt

SEQ ID NO: 979858 - DNA, 25 bp, Mus musculus
ttttctttcttcctggcatcactgt

SEQ ID NO: 979859 - DNA, 25 bp, Mus musculus
ttttctttcttcgtggcatcactgt

SEQ ID NO: 979860 - DNA, 25 bp, Mus musculus
ttttctttcttctgagcagccactt

SEQ ID NO: 979861 - DNA, 25 bp, Mus musculus
ttttctttcttgaagtagttgagac

SEQ ID NO: 979862 - DNA, 25 bp, Mus musculus
ttttctttcttgtagtagttgagac

SEQ ID NO: 979863 - DNA, 25 bp, Mus musculus
ttttctttgacaagctcttatctcc

SEQ ID NO: 979864 - DNA, 25 bp, Mus musculus
ttttctttgacatgctcttatctcc

SEQ ID NO: 979865 - DNA, 25 bp, Mus musculus
ttttctttgatcatgcttttccttt

SEQ ID NO: 979866 - DNA, 25 bp, Mus musculus
ttttctttgatcttgcttttccttt

SEQ ID NO: 979867 - DNA, 25 bp, Mus musculus
ttttctttgcacattgtcctgtcca

SEQ ID NO: 979868 - DNA, 25 bp, Mus musculus
ttttctttgcactttgtcctgtcca

SEQ ID NO: 979869 - DNA, 25 bp, Mus musculus
ttttctttgccgctttgcatgagtg

SEQ ID NO: 979870 - DNA, 25 bp, Mus musculus
ttttctttgccggtttgcatgagtg

SEQ ID NO: 979871 - DNA, 25 bp, Mus musculus
ttttctttgcctatgatgtcctgct

SEQ ID NO: 979872 - DNA, 25 bp, Mus musculus
ttttctttgcctttgatgtcctgct

SEQ ID NO: 979873 - DNA, 25 bp, Mus musculus
ttttctttggacatggaacttggta

SEQ ID NO: 979874 - DNA, 25 bp, Mus musculus
ttttctttggacttggaacttggta

SEQ ID NO: 979875 - DNA, 25 bp, Mus musculus
ttttctttggccaactgcttagaag

SEQ ID NO: 979876 - DNA, 25 bp, Mus musculus
ttttctttggcctactgcttagaag

SEQ ID NO: 979877 - DNA, 25 bp, Mus musculus
ttttctttgggacactttgccacca

SEQ ID NO: 979878 - DNA, 25 bp, Mus musculus
ttttctttgggagactttgccacca

SEQ ID NO: 979879 - DNA, 25 bp, Mus musculus
ttttctttgtccctagactgtttgg

SEQ ID NO: 979880 - DNA, 25 bp, Mus musculus
ttttctttgtccgtagactgtttgg

SEQ ID NO: 979881 - DNA, 25 bp, Mus musculus
ttttctttgtctagtttctgtgcac

SEQ ID NO: 979882 - DNA, 25 bp, Mus musculus
ttttctttgtcttgtttctgtgcac

SEQ ID NO: 979883 - DNA, 25 bp, Mus musculus
ttttcttttcagctcttcctaattt

SEQ ID NO: 979884 - DNA, 25 bp, Mus musculus
ttttcttttcagctgtgtgggaagt

SEQ ID NO: 979885 - DNA, 25 bp, Mus musculus
ttttcttttcaggtcttcctaattt

SEQ ID NO: 979886 - DNA, 25 bp, Mus musculus
ttttcttttcaggtgtgtgggaagt

SEQ ID NO: 979887 - DNA, 25 bp, Mus musculus
ttttcttttgcacggaaattccaat

SEQ ID NO: 979888 - DNA, 25 bp, Mus musculus
ttttcttttgcagggaaattccaat

SEQ ID NO: 979889 - DNA, 25 bp, Mus musculus
ttttcttttgctactcctggagaag

SEQ ID NO: 979890 - DNA, 25 bp, Mus musculus
ttttcttttgctcggcatccattca

SEQ ID NO: 979891 - DNA, 25 bp, Mus musculus
ttttcttttgctgggcatccattca

SEQ ID NO: 979892 - DNA, 25 bp, Mus musculus
ttttcttttgcttctcctggagaag

SEQ ID NO: 979893 - DNA, 25 bp, Mus musculus
ttttcttttggaatggccctgtggt

SEQ ID NO: 979894 - DNA, 25 bp, Mus musculus
ttttcttttggattggccctgtggt

SEQ ID NO: 979895 - DNA, 25 bp, Mus musculus
ttttcttttggcctagctaaagtat

SEQ ID NO: 979896 - DNA, 25 bp, Mus musculus
ttttcttttggcgtagctaaagtat

SEQ ID NO: 979897 - DNA, 25 bp, Mus musculus
ttttctttttccataagtccatgac

SEQ ID NO: 979898 - DNA, 25 bp, Mus musculus
ttttctttttccttaagtccatgac

SEQ ID NO: 979899 - DNA, 25 bp, Mus musculus
ttttctttttgcacagacctgtctc

SEQ ID NO: 979900 - DNA, 25 bp, Mus musculus
ttttctttttgcagaagtaccacta

SEQ ID NO: 979901 - DNA, 25 bp, Mus musculus
ttttctttttgccagcagacagact

SEQ ID NO: 979902 - DNA, 25 bp, Mus musculus
ttttctttttgcgagcagacagact

SEQ ID NO: 979903 - DNA, 25 bp, Mus musculus
ttttctttttgctcagacctgtctc

SEQ ID NO: 979904 - DNA, 25 bp, Mus musculus
ttttctttttgctgaagtaccacta

SEQ ID NO: 979905 - DNA, 25 bp, Mus musculus
ttttctttttgtaccaatggatctg

SEQ ID NO: 979906 - DNA, 25 bp, Mus musculus
ttttctttttgtagctgtcctggaa

SEQ ID NO: 979907 - DNA, 25 bp, Mus musculus
ttttctttttgttccaatggatctg

SEQ ID NO: 979908 - DNA, 25 bp, Mus musculus
ttttctttttgttgctgtcctggaa

SEQ ID NO: 979909 - DNA, 25 bp, Mus musculus
ttttgaaaacagacttccagaagct

SEQ ID NO: 979910 - DNA, 25 bp, Mus musculus
ttttgaaaacagtcttccagaagct

SEQ ID NO: 979911 - DNA, 25 bp, Mus musculus
ttttgaaaagcaccccttaggcagt

SEQ ID NO: 979912 - DNA, 25 bp, Mus musculus
ttttgaaaagcagcccttaggcagt

SEQ ID NO: 979913 - DNA, 25 bp, Mus musculus
ttttgaaacacgagaagccctgcca

SEQ ID NO: 979914 - DNA, 25 bp, Mus musculus
ttttgaaacacgtgaagccctgcca

SEQ ID NO: 979915 - DNA, 25 bp, Mus musculus
ttttgaaaccccatggctgtggtga

SEQ ID NO: 979916 - DNA, 25 bp, Mus musculus
ttttgaaaccccttggctgtggtga

SEQ ID NO: 979917 - DNA, 25 bp, Mus musculus
ttttgaaatatgctccaggcggcct

SEQ ID NO: 979918 - DNA, 25 bp, Mus musculus
ttttgaaatatggtccaggcggcct

SEQ ID NO: 979919 - DNA, 25 bp, Mus musculus
ttttgaaatgcaatctcttcctctg

SEQ ID NO: 979920 - DNA, 25 bp, Mus musculus
ttttgaaatgcattctcttcctctg

SEQ ID NO: 979921 - DNA, 25 bp, Mus musculus
ttttgaaatgctctggaaaccatct

SEQ ID NO: 979922 - DNA, 25 bp, Mus musculus
ttttgaaatgctgtggaaaccatct

SEQ ID NO: 979923 - DNA, 25 bp, Mus musculus
ttttgaaatggactcagatctggac

SEQ ID NO: 979924 - DNA, 25 bp, Mus musculus
ttttgaaatggagtcagatctggac

SEQ ID NO: 979925 - DNA, 25 bp, Mus musculus
ttttgaaccactactgcaacaacga

SEQ ID NO: 979926 - DNA, 25 bp, Mus musculus
ttttgaaccacttctgcaacaacga

SEQ ID NO: 979927 - DNA, 25 bp, Mus musculus
ttttgaacccttcgtactgactctg

SEQ ID NO: 979928 - DNA, 25 bp, Mus musculus
ttttgaacccttggtactgactctg

SEQ ID NO: 979929 - DNA, 25 bp, Mus musculus
ttttgaaccgtccatattggtcata

SEQ ID NO: 979930 - DNA, 25 bp, Mus musculus
ttttgaaccgtcgatattggtcata

SEQ ID NO: 979931 - DNA, 25 bp, Mus musculus
ttttgaactagcaccttctctgtag

SEQ ID NO: 979932 - DNA, 25 bp, Mus musculus
ttttgaactagctccttctctgtag

SEQ ID NO: 979933 - DNA, 25 bp, Mus musculus
ttttgaagacatcaaacccacactg

SEQ ID NO: 979934 - DNA, 25 bp, Mus musculus
ttttgaagacatgaaacccacactg

SEQ ID NO: 979935 - DNA, 25 bp, Mus musculus
ttttgaagaccaactgcctacctaa

SEQ ID NO: 979936 - DNA, 25 bp, Mus musculus
ttttgaagaccatctgcctacctaa

SEQ ID NO: 979937 - DNA, 25 bp, Mus musculus
ttttgaagagctcccaacacccaag

SEQ ID NO: 979938 - DNA, 25 bp, Mus musculus
ttttgaagagctgccaacacccaag

SEQ ID NO: 979939 - DNA, 25 bp, Mus musculus
ttttgaagaggcagctcccagagtc

SEQ ID NO: 979940 - DNA, 25 bp, Mus musculus
ttttgaagaggctgctcccagagtc

SEQ ID NO: 979941 - DNA, 25 bp, Mus musculus
ttttgaagccaaaagccctccatgg

SEQ ID NO: 979942 - DNA, 25 bp, Mus musculus
ttttgaagccaatagccctccatgg

SEQ ID NO: 979943 - DNA, 25 bp, Mus musculus
ttttgaagcccacctccagaacctg

SEQ ID NO: 979944 - DNA, 25 bp, Mus musculus
ttttgaagcccacctgagcgacgtg

SEQ ID NO: 979945 - DNA, 25 bp, Mus musculus
ttttgaagcccagctccagaacctg

SEQ ID NO: 979946 - DNA, 25 bp, Mus musculus
ttttgaagcccagctgagcgacgtg

SEQ ID NO: 979947 - DNA, 25 bp, Mus musculus
ttttgaagcctcatcatgtcagtcc

SEQ ID NO: 979948 - DNA, 25 bp, Mus musculus
ttttgaagcctcttcatgtcagtcc

SEQ ID NO: 979949 - DNA, 25 bp, Mus musculus
ttttgaaggttcactctgcgcagtt

SEQ ID NO: 979950 - DNA, 25 bp, Mus musculus
ttttgaaggttctctctgcgcagtt

SEQ ID NO: 979951 - DNA, 25 bp, Mus musculus
ttttgaatcttccttgtgcatcctg

SEQ ID NO: 979952 - DNA, 25 bp, Mus musculus
ttttgaatcttcgttgtgcatcctg

SEQ ID NO: 979953 - DNA, 25 bp, Mus musculus
ttttgaatcttgatctaactgcagc

SEQ ID NO: 979954 - DNA, 25 bp, Mus musculus
ttttgaatcttgttctaactgcagc

SEQ ID NO: 979955 - DNA, 25 bp, Mus musculus
ttttgaatgacacccagcacttctc

SEQ ID NO: 979956 - DNA, 25 bp, Mus musculus
ttttgaatgacagccagcacttctc

SEQ ID NO: 979957 - DNA, 25 bp, Mus musculus
ttttgaatggtcagtattagccggg

SEQ ID NO: 979958 - DNA, 25 bp, Mus musculus
ttttgaatggtctgtattagccggg

SEQ ID NO: 979959 - DNA, 25 bp, Mus musculus
ttttgaatgttcatgctaggagaca

SEQ ID NO: 979960 - DNA, 25 bp, Mus musculus
ttttgaatgttcttgctaggagaca

SEQ ID NO: 979961 - DNA, 25 bp, Mus musculus
ttttgaatgtttactctccttctgc

SEQ ID NO: 979962 - DNA, 25 bp, Mus musculus
ttttgaatgttttctctccttctgc

SEQ ID NO: 979963 - DNA, 25 bp, Mus musculus
ttttgaattcccatgtaactgtttg

SEQ ID NO: 979964 - DNA, 25 bp, Mus musculus
ttttgaattcccctgcaggtttaat

SEQ ID NO: 979965 - DNA, 25 bp, Mus musculus
ttttgaattcccgtgcaggtttaat

SEQ ID NO: 979966 - DNA, 25 bp, Mus musculus
ttttgaattcccttgtaactgtttg

SEQ ID NO: 979967 - DNA, 25 bp, Mus musculus
ttttgacaagcacatcccttgctcc

SEQ ID NO: 979968 - DNA, 25 bp, Mus musculus
ttttgacaagcagatcccttgctcc

SEQ ID NO: 979969 - DNA, 25 bp, Mus musculus
ttttgacaccttatagacctgtaag

SEQ ID NO: 979970 - DNA, 25 bp, Mus musculus
ttttgacaccttttagacctgtaag

SEQ ID NO: 979971 - DNA, 25 bp, Mus musculus
ttttgacactcaagacctgggaagc

SEQ ID NO: 979972 - DNA, 25 bp, Mus musculus
ttttgacactcatgacctgggaagc

SEQ ID NO: 979973 - DNA, 25 bp, Mus musculus
ttttgacacttacaggagggcctcc

SEQ ID NO: 979974 - DNA, 25 bp, Mus musculus
ttttgacacttagaggagggcctcc

SEQ ID NO: 979975 - DNA, 25 bp, Mus musculus
ttttgacagaggcttaatgttttaa

SEQ ID NO: 979976 - DNA, 25 bp, Mus musculus
ttttgacagagggttaatgttttaa

SEQ ID NO: 979977 - DNA, 25 bp, Mus musculus
ttttgacagttgatccctgtaccca

SEQ ID NO: 979978 - DNA, 25 bp, Mus musculus
ttttgacagttgttccctgtaccca

SEQ ID NO: 979979 - DNA, 25 bp, Mus musculus
ttttgacatattatgtagcagaatt

SEQ ID NO: 979980 - DNA, 25 bp, Mus musculus
ttttgacatattttgtagcagaatt

SEQ ID NO: 979981 - DNA, 25 bp, Mus musculus
ttttgacatgttagcccagaccaga

SEQ ID NO: 979982 - DNA, 25 bp, Mus musculus
ttttgacatgtttgcccagaccaga

SEQ ID NO: 979983 - DNA, 25 bp, Mus musculus
ttttgaccacatcaggacagtcatt

SEQ ID NO: 979984 - DNA, 25 bp, Mus musculus
ttttgaccacatgaggacagtcatt

SEQ ID NO: 979985 - DNA, 25 bp, Mus musculus
ttttgaccacttcatttacctgctc

SEQ ID NO: 979986 - DNA, 25 bp, Mus musculus
ttttgaccacttgatttacctgctc

SEQ ID NO: 979987 - DNA, 25 bp, Mus musculus
ttttgaccatctcatctcagtgtat

SEQ ID NO: 979988 - DNA, 25 bp, Mus musculus
ttttgaccatctgatctcagtgtat

SEQ ID NO: 979989 - DNA, 25 bp, Mus musculus
ttttgaccatggacgctacagctga

SEQ ID NO: 979990 - DNA, 25 bp, Mus musculus
ttttgaccatggtcgctacagctga

SEQ ID NO: 979991 - DNA, 25 bp, Mus musculus
ttttgacccagaagccaatacgtgg

SEQ ID NO: 979992 - DNA, 25 bp, Mus musculus
ttttgacccagatgccaatacgtgg

SEQ ID NO: 979993 - DNA, 25 bp, Mus musculus
ttttgacccatgcaatattcccagc

SEQ ID NO: 979994 - DNA, 25 bp, Mus musculus
ttttgacccatggaatattcccagc

SEQ ID NO: 979995 - DNA, 25 bp, Mus musculus
ttttgacccattaaccacagctcaa

SEQ ID NO: 979996 - DNA, 25 bp, Mus musculus
ttttgacccatttaccacagctcaa

SEQ ID NO: 979997 - DNA, 25 bp, Mus musculus
ttttgaccccttcaagacttcacaa

SEQ ID NO: 979998 - DNA, 25 bp, Mus musculus
ttttgaccccttgaagacttcacaa

SEQ ID NO: 979999 - DNA, 25 bp, Mus musculus
ttttgacccgatccgtcccagagga

SEQ ID NO: 980000 - DNA, 25 bp, Mus musculus
ttttgacccgatgcgtcccagagga

SEQ ID NO: 980001 - DNA, 25 bp, Mus musculus
ttttgacccggtcgatgaagaaagc

SEQ ID NO: 980002 - DNA, 25 bp, Mus musculus
ttttgacccggtggatgaagaaagc

SEQ ID NO: 980003 - DNA, 25 bp, Mus musculus
ttttgaccctatatcgctttacatt

SEQ ID NO: 980004 - DNA, 25 bp, Mus musculus
ttttgaccctatttcgctttacatt

SEQ ID NO: 980005 - DNA, 25 bp, Mus musculus
ttttgaccctgaattcacacacacg

SEQ ID NO: 980006 - DNA, 25 bp, Mus musculus
ttttgaccctgatttcacacacacg

SEQ ID NO: 980007 - DNA, 25 bp, Mus musculus
ttttgaccgttccttgaacccatgt

SEQ ID NO: 980008 - DNA, 25 bp, Mus musculus
ttttgaccgttcgttgaacccatgt

SEQ ID NO: 980009 - DNA, 25 bp, Mus musculus
ttttgacctgttaatttccactgta

SEQ ID NO: 980010 - DNA, 25 bp, Mus musculus
ttttgacctgtttatttccactgta

SEQ ID NO: 980011 - DNA, 25 bp, Mus musculus
ttttgaccttcccactgacagtctt

SEQ ID NO: 980012 - DNA, 25 bp, Mus musculus
ttttgaccttccgactgacagtctt

SEQ ID NO: 980013 - DNA, 25 bp, Mus musculus
ttttgacgtcatcgacaacctcatc

SEQ ID NO: 980014 - DNA, 25 bp, Mus musculus
ttttgacgtcatggacaacctcatc

SEQ ID NO: 980015 - DNA, 25 bp, Mus musculus
ttttgactaaacaaaaggcccagat

SEQ ID NO: 980016 - DNA, 25 bp, Mus musculus
ttttgactaaactaaaggcccagat

SEQ ID NO: 980017 - DNA, 25 bp, Mus musculus
ttttgactaataacgactgcccctg

SEQ ID NO: 980018 - DNA, 25 bp, Mus musculus
ttttgactaatatcgactgcccctg

SEQ ID NO: 980019 - DNA, 25 bp, Mus musculus
ttttgactaatcatcctcagaataa

SEQ ID NO: 980020 - DNA, 25 bp, Mus musculus
ttttgactaatcttcctcagaataa

SEQ ID NO: 980021 - DNA, 25 bp, Mus musculus
ttttgactatagattggtgctgtat

SEQ ID NO: 980022 - DNA, 25 bp, Mus musculus
ttttgactatagtttggtgctgtat

SEQ ID NO: 980023 - DNA, 25 bp, Mus musculus
ttttgactatttccgccacatctgt

SEQ ID NO: 980024 - DNA, 25 bp, Mus musculus
ttttgactatttgcgccacatctgt

SEQ ID NO: 980025 - DNA, 25 bp, Mus musculus
ttttgactccctattcatgcaatgt

SEQ ID NO: 980026 - DNA, 25 bp, Mus musculus
ttttgactcccttttcatgcaatgt

SEQ ID NO: 980027 - DNA, 25 bp, Mus musculus
ttttgactctacaccacatggcaca

SEQ ID NO: 980028 - DNA, 25 bp, Mus musculus
ttttgactctactccacatggcaca

SEQ ID NO: 980029 - DNA, 25 bp, Mus musculus
ttttgactctgccttacctttgtaa

SEQ ID NO: 980030 - DNA, 25 bp, Mus musculus
ttttgactctgcgttacctttgtaa

SEQ ID NO: 980031 - DNA, 25 bp, Mus musculus
ttttgactctggcaaaaccgcccat

SEQ ID NO: 980032 - DNA, 25 bp, Mus musculus
ttttgactctgggaaaaccgcccat

SEQ ID NO: 980033 - DNA, 25 bp, Mus musculus
ttttgacttgggatgtagcacaggc

SEQ ID NO: 980034 - DNA, 25 bp, Mus musculus
ttttgacttgggttgtagcacaggc

SEQ ID NO: 980035 - DNA, 25 bp, Mus musculus
ttttgacttgtcactaatcgccgcc

SEQ ID NO: 980036 - DNA, 25 bp, Mus musculus
ttttgacttgtctctaatcgccgcc

SEQ ID NO: 980037 - DNA, 25 bp, Mus musculus
ttttgactttagctacctggaaatg

SEQ ID NO: 980038 - DNA, 25 bp, Mus musculus
ttttgactttaggtacctggaaatg

SEQ ID NO: 980039 - DNA, 25 bp, Mus musculus
ttttgagaatcactctcccctgaaa

SEQ ID NO: 980040 - DNA, 25 bp, Mus musculus
ttttgagaatcagtctcccctgaaa

SEQ ID NO: 980041 - DNA, 25 bp, Mus musculus
ttttgagacacacggtcgctaggta

SEQ ID NO: 980042 - DNA, 25 bp, Mus musculus
ttttgagacacagggtcgctaggta

SEQ ID NO: 980043 - DNA, 25 bp, Mus musculus
ttttgagacagcctgtgttgagaca

SEQ ID NO: 980044 - DNA, 25 bp, Mus musculus
ttttgagacagcgtgtgttgagaca

SEQ ID NO: 980045 - DNA, 25 bp, Mus musculus
ttttgagacaggagtcaccccgtag

SEQ ID NO: 980046 - DNA, 25 bp, Mus musculus
ttttgagacaggtgtcaccccgtag

SEQ ID NO: 980047 - DNA, 25 bp, Mus musculus
ttttgagaccctcctgtcccagaac

SEQ ID NO: 980048 - DNA, 25 bp, Mus musculus
ttttgagaccctgctgtcccagaac

SEQ ID NO: 980049 - DNA, 25 bp, Mus musculus
ttttgagaccttagttttcacctct

SEQ ID NO: 980050 - DNA, 25 bp, Mus musculus
ttttgagacctttgttttcacctct

SEQ ID NO: 980051 - DNA, 25 bp, Mus musculus
ttttgagagggcaagctactggctt

SEQ ID NO: 980052 - DNA, 25 bp, Mus musculus
ttttgagagggctagctactggctt

SEQ ID NO: 980053 - DNA, 25 bp, Mus musculus
ttttgagatcccaggtgtggtagca

SEQ ID NO: 980054 - DNA, 25 bp, Mus musculus
ttttgagatccctggtgtggtagca

SEQ ID NO: 980055 - DNA, 25 bp, Mus musculus
ttttgagatgttctcactgtcctgc

SEQ ID NO: 980056 - DNA, 25 bp, Mus musculus
ttttgagatgttgtcactgtcctgc

SEQ ID NO: 980057 - DNA, 25 bp, Mus musculus
ttttgagcacccaccaaattttgga

SEQ ID NO: 980058 - DNA, 25 bp, Mus musculus
ttttgagcaccctccaaattttgga

SEQ ID NO: 980059 - DNA, 25 bp, Mus musculus
ttttgagcaccgcatgccccgggag

SEQ ID NO: 980060 - DNA, 25 bp, Mus musculus
ttttgagcaccggatgccccgggag

SEQ ID NO: 980061 - DNA, 25 bp, Mus musculus
ttttgagcacggctgctggcaccca

SEQ ID NO: 980062 - DNA, 25 bp, Mus musculus
ttttgagcacgggtgctggcaccca

SEQ ID NO: 980063 - DNA, 25 bp, Mus musculus
ttttgagcatggagtaacaaccttg

SEQ ID NO: 980064 - DNA, 25 bp, Mus musculus
ttttgagcatggtgtaacaaccttg

SEQ ID NO: 980065 - DNA, 25 bp, Mus musculus
ttttgagccctacagcagactagaa

SEQ ID NO: 980066 - DNA, 25 bp, Mus musculus
ttttgagccctagagcagactagaa

SEQ ID NO: 980067 - DNA, 25 bp, Mus musculus
ttttgagcctagctttgccctgagg

SEQ ID NO: 980068 - DNA, 25 bp, Mus musculus
ttttgagcctaggtttgccctgagg

SEQ ID NO: 980069 - DNA, 25 bp, Mus musculus
ttttgagcctttatttcaggccttg

SEQ ID NO: 980070 - DNA, 25 bp, Mus musculus
ttttgagcctttttttcaggccttg

SEQ ID NO: 980071 - DNA, 25 bp, Mus musculus
ttttgagcgaccagaccaactgcac

SEQ ID NO: 980072 - DNA, 25 bp, Mus musculus
ttttgagcgacctgaccaactgcac

SEQ ID NO: 980073 - DNA, 25 bp, Mus musculus
ttttgagcgcttactaggcactgat

SEQ ID NO: 980074 - DNA, 25 bp, Mus musculus
ttttgagcgctttctaggcactgat

SEQ ID NO: 980075 - DNA, 25 bp, Mus musculus
ttttgagctgtgaacccatgtgtcc

SEQ ID NO: 980076 - DNA, 25 bp, Mus musculus
ttttgagctgtgtacccatgtgtcc

SEQ ID NO: 980077 - DNA, 25 bp, Mus musculus
ttttgaggatgcctgccagcacaca

SEQ ID NO: 980078 - DNA, 25 bp, Mus musculus
ttttgaggatgcgtgccagcacaca

SEQ ID NO: 980079 - DNA, 25 bp, Mus musculus
ttttgaggatttcttcttctctaga

SEQ ID NO: 980080 - DNA, 25 bp, Mus musculus
ttttgaggatttgttcttctctaga

SEQ ID NO: 980081 - DNA, 25 bp, Mus musculus
ttttgaggccccacattagagtaaa

SEQ ID NO: 980082 - DNA, 25 bp, Mus musculus
ttttgaggcccctcattagagtaaa

SEQ ID NO: 980083 - DNA, 25 bp, Mus musculus
ttttgaggctaaagtcccctatccg

SEQ ID NO: 980084 - DNA, 25 bp, Mus musculus
ttttgaggctaatgtcccctatccg

SEQ ID NO: 980085 - DNA, 25 bp, Mus musculus
ttttgagggaaacctctcactatgt

SEQ ID NO: 980086 - DNA, 25 bp, Mus musculus
ttttgagggaaagctctcactatgt

SEQ ID NO: 980087 - DNA, 25 bp, Mus musculus
ttttgagggccgagatagaccccgg

SEQ ID NO: 980088 - DNA, 25 bp, Mus musculus
ttttgagggccgtgatagaccccgg

SEQ ID NO: 980089 - DNA, 25 bp, Mus musculus
ttttgaggtccaagggtaagaggat

SEQ ID NO: 980090 - DNA, 25 bp, Mus musculus
ttttgaggtccactcgctgtggctc

SEQ ID NO: 980091 - DNA, 25 bp, Mus musculus
ttttgaggtccagtcgctgtggctc

SEQ ID NO: 980092 - DNA, 25 bp, Mus musculus
ttttgaggtccatgggtaagaggat

SEQ ID NO: 980093 - DNA, 25 bp, Mus musculus
ttttgaggtcttagtgtccaaggag

SEQ ID NO: 980094 - DNA, 25 bp, Mus musculus
ttttgaggtctttgtgtccaaggag

SEQ ID NO: 980095 - DNA, 25 bp, Mus musculus
ttttgagtacgtatggctattctat

SEQ ID NO: 980096 - DNA, 25 bp, Mus musculus
ttttgagtacgtttggctattctat

SEQ ID NO: 980097 - DNA, 25 bp, Mus musculus
ttttgagtcctgaggtccatcctag

SEQ ID NO: 980098 - DNA, 25 bp, Mus musculus
ttttgagtcctgtggtccatcctag

SEQ ID NO: 980099 - DNA, 25 bp, Mus musculus
ttttgagtgaggctctcaccctagc

SEQ ID NO: 980100 - DNA, 25 bp, Mus musculus
ttttgagtgagggtctcaccctagc

SEQ ID NO: 980101 - DNA, 25 bp, Mus musculus
ttttgagtgtcacgtccagggatga

SEQ ID NO: 980102 - DNA, 25 bp, Mus musculus
ttttgagtgtcaggtccagggatga

SEQ ID NO: 980103 - DNA, 25 bp, Mus musculus
ttttgagttcagcgcctgcctagtt

SEQ ID NO: 980104 - DNA, 25 bp, Mus musculus
ttttgagttcagggcctgcctagtt

SEQ ID NO: 980105 - DNA, 25 bp, Mus musculus
ttttgagttggacaaccactgctgt

SEQ ID NO: 980106 - DNA, 25 bp, Mus musculus
ttttgagttggagaaccactgctgt

SEQ ID NO: 980107 - DNA, 25 bp, Mus musculus
ttttgataacccaaattacccatag

SEQ ID NO: 980108 - DNA, 25 bp, Mus musculus
ttttgataacccaaggactctgctc

SEQ ID NO: 980109 - DNA, 25 bp, Mus musculus
ttttgataaccctaattacccatag

SEQ ID NO: 980110 - DNA, 25 bp, Mus musculus
ttttgataaccctaggactctgctc

SEQ ID NO: 980111 - DNA, 25 bp, Mus musculus
ttttgataagcaactctagggcagt

SEQ ID NO: 980112 - DNA, 25 bp, Mus musculus
ttttgataagcatctctagggcagt

SEQ ID NO: 980113 - DNA, 25 bp, Mus musculus
ttttgatacccacccttagcaggga

SEQ ID NO: 980114 - DNA, 25 bp, Mus musculus
ttttgatacccagccttagcaggga

SEQ ID NO: 980115 - DNA, 25 bp, Mus musculus
ttttgatatgctaagaaaccacaca

SEQ ID NO: 980116 - DNA, 25 bp, Mus musculus
ttttgatatgcttagaaaccacaca

SEQ ID NO: 980117 - DNA, 25 bp, Mus musculus
ttttgatattgtatctcccacagcg

SEQ ID NO: 980118 - DNA, 25 bp, Mus musculus
ttttgatattgtttctcccacagcg

SEQ ID NO: 980119 - DNA, 25 bp, Mus musculus
ttttgatcacgcagcgcccggcttt

SEQ ID NO: 980120 - DNA, 25 bp, Mus musculus
ttttgatcacgctgcgcccggcttt

SEQ ID NO: 980121 - DNA, 25 bp, Mus musculus
ttttgatcagcaaagttgtagatta

SEQ ID NO: 980122 - DNA, 25 bp, Mus musculus
ttttgatcagcatagttgtagatta

SEQ ID NO: 980123 - DNA, 25 bp, Mus musculus
ttttgatcatctcatgtcctccata

SEQ ID NO: 980124 - DNA, 25 bp, Mus musculus
ttttgatcatctgatgtcctccata

SEQ ID NO: 980125 - DNA, 25 bp, Mus musculus
ttttgatccaacatctgggaaaagt

SEQ ID NO: 980126 - DNA, 25 bp, Mus musculus
ttttgatccaacttctgggaaaagt

SEQ ID NO: 980127 - DNA, 25 bp, Mus musculus
ttttgatcccaaaatgctgcggagt

SEQ ID NO: 980128 - DNA, 25 bp, Mus musculus
ttttgatcccaatatgctgcggagt

SEQ ID NO: 980129 - DNA, 25 bp, Mus musculus
ttttgatcctcacacaccgtttcct

SEQ ID NO: 980130 - DNA, 25 bp, Mus musculus
ttttgatcctcagacaccgtttcct

SEQ ID NO: 980131 - DNA, 25 bp, Mus musculus
ttttgatctactacactcttctcag

SEQ ID NO: 980132 - DNA, 25 bp, Mus musculus
ttttgatctacttcactcttctcag

SEQ ID NO: 980133 - DNA, 25 bp, Mus musculus
ttttgatctgtgagtgccgtgtgtg

SEQ ID NO: 980134 - DNA, 25 bp, Mus musculus
ttttgatctgtgtgtgccgtgtgtg

SEQ ID NO: 980135 - DNA, 25 bp, Mus musculus
ttttgatctgttatggtcgtccctc

SEQ ID NO: 980136 - DNA, 25 bp, Mus musculus
ttttgatctgttttggtcgtccctc

SEQ ID NO: 980137 - DNA, 25 bp, Mus musculus
ttttgatcttcccagagcagatgtc

SEQ ID NO: 980138 - DNA, 25 bp, Mus musculus
ttttgatcttccgagagcagatgtc

SEQ ID NO: 980139 - DNA, 25 bp, Mus musculus
ttttgatgagtgctttgtgttttct

SEQ ID NO: 980140 - DNA, 25 bp, Mus musculus
ttttgatgagtggtttgtgttttct

SEQ ID NO: 980141 - DNA, 25 bp, Mus musculus
ttttgatgcaacaactgtctaaatt

SEQ ID NO: 980142 - DNA, 25 bp, Mus musculus
ttttgatgcaactactgtctaaatt

SEQ ID NO: 980143 - DNA, 25 bp, Mus musculus
ttttgatgcgtactgtttattcaag

SEQ ID NO: 980144 - DNA, 25 bp, Mus musculus
ttttgatgcgtagtgtttattcaag

SEQ ID NO: 980145 - DNA, 25 bp, Mus musculus
ttttgatgctccacatctagactcc

SEQ ID NO: 980146 - DNA, 25 bp, Mus musculus
ttttgatgctcctcatctagactcc

SEQ ID NO: 980147 - DNA, 25 bp, Mus musculus
ttttgatggagcaagcttcattggg

SEQ ID NO: 980148 - DNA, 25 bp, Mus musculus
ttttgatggagctagcttcattggg

SEQ ID NO: 980149 - DNA, 25 bp, Mus musculus
ttttgatggattctccagtggccaa

SEQ ID NO: 980150 - DNA, 25 bp, Mus musculus
ttttgatggattgtccagtggccaa

SEQ ID NO: 980151 - DNA, 25 bp, Mus musculus
ttttgatgtccgaactgaagcagtc

SEQ ID NO: 980152 - DNA, 25 bp, Mus musculus
ttttgatgtccgtactgaagcagtc

SEQ ID NO: 980153 - DNA, 25 bp, Mus musculus
ttttgatgtgccataagttctctgg

SEQ ID NO: 980154 - DNA, 25 bp, Mus musculus
ttttgatgtgccttaagttctctgg

SEQ ID NO: 980155 - DNA, 25 bp, Mus musculus
ttttgatgtttcatggtgacctgcc

SEQ ID NO: 980156 - DNA, 25 bp, Mus musculus
ttttgatgtttcttggtgacctgcc

SEQ ID NO: 980157 - DNA, 25 bp, Mus musculus
ttttgattaattagttctgattttt

SEQ ID NO: 980158 - DNA, 25 bp, Mus musculus
ttttgattaatttgttctgattttt

SEQ ID NO: 980159 - DNA, 25 bp, Mus musculus
ttttgattacagatacagccaggct

SEQ ID NO: 980160 - DNA, 25 bp, Mus musculus
ttttgattacagttacagccaggct

SEQ ID NO: 980161 - DNA, 25 bp, Mus musculus
ttttgattagctctgtgcatgtgtg

SEQ ID NO: 980162 - DNA, 25 bp, Mus musculus
ttttgattagctgtgtgcatgtgtg

SEQ ID NO: 980163 - DNA, 25 bp, Mus musculus
ttttgattataactgtgtccctttt

SEQ ID NO: 980164 - DNA, 25 bp, Mus musculus
ttttgattataagtgtgtccctttt

SEQ ID NO: 980165 - DNA, 25 bp, Mus musculus
ttttgattcctaccgtaaactggtt

SEQ ID NO: 980166 - DNA, 25 bp, Mus musculus
ttttgattcctagcgtaaactggtt

SEQ ID NO: 980167 - DNA, 25 bp, Mus musculus
ttttgattctctaatcctgtgtgca

SEQ ID NO: 980168 - DNA, 25 bp, Mus musculus
ttttgattctcttatcctgtgtgca

SEQ ID NO: 980169 - DNA, 25 bp, Mus musculus
ttttgattctttcccactcactggg

SEQ ID NO: 980170 - DNA, 25 bp, Mus musculus
ttttgattctttgccactcactggg

SEQ ID NO: 980171 - DNA, 25 bp, Mus musculus
ttttgattggttcggtagtgtgcac

SEQ ID NO: 980172 - DNA, 25 bp, Mus musculus
ttttgattggttgggtagtgtgcac

SEQ ID NO: 980173 - DNA, 25 bp, Mus musculus
ttttgattgtgtatccccagtgctc

SEQ ID NO: 980174 - DNA, 25 bp, Mus musculus
ttttgattgtgtttccccagtgctc

SEQ ID NO: 980175 - DNA, 25 bp, Mus musculus
ttttgattgttccagcagcgtgtgg

SEQ ID NO: 980176 - DNA, 25 bp, Mus musculus
ttttgattgttcgagcagcgtgtgg

SEQ ID NO: 980177 - DNA, 25 bp, Mus musculus
ttttgattttcaatctgagacactg

SEQ ID NO: 980178 - DNA, 25 bp, Mus musculus
ttttgattttcattctgagacactg

SEQ ID NO: 980179 - DNA, 25 bp, Mus musculus
ttttgattttctaatccggctgctc

SEQ ID NO: 980180 - DNA, 25 bp, Mus musculus
ttttgattttcttatccggctgctc

SEQ ID NO: 980181 - DNA, 25 bp, Mus musculus
ttttgcaaacacatggcttagattt

SEQ ID NO: 980182 - DNA, 25 bp, Mus musculus
ttttgcaaacacttggcttagattt

SEQ ID NO: 980183 - DNA, 25 bp, Mus musculus
ttttgcaaactgcttttactcgttt

SEQ ID NO: 980184 - DNA, 25 bp, Mus musculus
ttttgcaaactggttttactcgttt

SEQ ID NO: 980185 - DNA, 25 bp, Mus musculus
ttttgcaacaccaagctcacagcag

SEQ ID NO: 980186 - DNA, 25 bp, Mus musculus
ttttgcaacacctagctcacagcag

SEQ ID NO: 980187 - DNA, 25 bp, Mus musculus
ttttgcaacgccaaaggggcagatt

SEQ ID NO: 980188 - DNA, 25 bp, Mus musculus
ttttgcaacgcctaaggggcagatt

SEQ ID NO: 980189 - DNA, 25 bp, Mus musculus
ttttgcaagcaaagcctcaggtaga

SEQ ID NO: 980190 - DNA, 25 bp, Mus musculus
ttttgcaagcaatgcctcaggtaga

SEQ ID NO: 980191 - DNA, 25 bp, Mus musculus
ttttgcaagctaagtgccttcctgg

SEQ ID NO: 980192 - DNA, 25 bp, Mus musculus
ttttgcaagctatgtgccttcctgg

SEQ ID NO: 980193 - DNA, 25 bp, Mus musculus
ttttgcaatagtagccgcctaacct

SEQ ID NO: 980194 - DNA, 25 bp, Mus musculus
ttttgcaatagttgccgcctaacct

SEQ ID NO: 980195 - DNA, 25 bp, Mus musculus
ttttgcaatccaaccagccttgtgg

SEQ ID NO: 980196 - DNA, 25 bp, Mus musculus
ttttgcaatccatccagccttgtgg

SEQ ID NO: 980197 - DNA, 25 bp, Mus musculus
ttttgcaatgtaccctaaaggaggc

SEQ ID NO: 980198 - DNA, 25 bp, Mus musculus
ttttgcaatgtagcctaaaggaggc

SEQ ID NO: 980199 - DNA, 25 bp, Mus musculus
ttttgcacaaagagtatcttcagag

SEQ ID NO: 980200 - DNA, 25 bp, Mus musculus
ttttgcacaaagtgtatcttcagag

SEQ ID NO: 980201 - DNA, 25 bp, Mus musculus
ttttgcacaccgcttttgagagccc

SEQ ID NO: 980202 - DNA, 25 bp, Mus musculus
ttttgcacaccggttttgagagccc

SEQ ID NO: 980203 - DNA, 25 bp, Mus musculus
ttttgcacacctagggttttctaag

SEQ ID NO: 980204 - DNA, 25 bp, Mus musculus
ttttgcacaccttgggttttctaag

SEQ ID NO: 980205 - DNA, 25 bp, Mus musculus
ttttgcacactaagttatatactgt

SEQ ID NO: 980206 - DNA, 25 bp, Mus musculus
ttttgcacactatgttatatactgt

SEQ ID NO: 980207 - DNA, 25 bp, Mus musculus
ttttgcacagtaaaaagctctggct

SEQ ID NO: 980208 - DNA, 25 bp, Mus musculus
ttttgcacagtataaagctctggct

SEQ ID NO: 980209 - DNA, 25 bp, Mus musculus
ttttgcacccttcccattaggacaa

SEQ ID NO: 980210 - DNA, 25 bp, Mus musculus
ttttgcacccttgccattaggacaa

SEQ ID NO: 980211 - DNA, 25 bp, Mus musculus
ttttgcactacgaagccaggaccac

SEQ ID NO: 980212 - DNA, 25 bp, Mus musculus
ttttgcactacgtagccaggaccac

SEQ ID NO: 980213 - DNA, 25 bp, Mus musculus
ttttgcactgccaattctcatcatt

SEQ ID NO: 980214 - DNA, 25 bp, Mus musculus
ttttgcactgcctattctcatcatt

SEQ ID NO: 980215 - DNA, 25 bp, Mus musculus
ttttgcagactcacatgtggtgcaa

SEQ ID NO: 980216 - DNA, 25 bp, Mus musculus
ttttgcagactctcatgtggtgcaa

SEQ ID NO: 980217 - DNA, 25 bp, Mus musculus
ttttgcagagagatacgattttgtt

SEQ ID NO: 980218 - DNA, 25 bp, Mus musculus
ttttgcagagagttacgattttgtt

SEQ ID NO: 980219 - DNA, 25 bp, Mus musculus
ttttgcagagccaatcaatgtctaa

SEQ ID NO: 980220 - DNA, 25 bp, Mus musculus
ttttgcagagcctatcaatgtctaa

SEQ ID NO: 980221 - DNA, 25 bp, Mus musculus
ttttgcagatgtaataaactttaat

SEQ ID NO: 980222 - DNA, 25 bp, Mus musculus
ttttgcagatgttataaactttaat

SEQ ID NO: 980223 - DNA, 25 bp, Mus musculus
ttttgcagcatcaaatccatcaagt

SEQ ID NO: 980224 - DNA, 25 bp, Mus musculus
ttttgcagcatcacacagcttccga

SEQ ID NO: 980225 - DNA, 25 bp, Mus musculus
ttttgcagcatctaatccatcaagt

SEQ ID NO: 980226 - DNA, 25 bp, Mus musculus
ttttgcagcatctcacagcttccga

SEQ ID NO: 980227 - DNA, 25 bp, Mus musculus
ttttgcagcccaagacccaacaaat

SEQ ID NO: 980228 - DNA, 25 bp, Mus musculus
ttttgcagcccatgacccaacaaat

SEQ ID NO: 980229 - DNA, 25 bp, Mus musculus
ttttgcagggttagagtaaggtatt

SEQ ID NO: 980230 - DNA, 25 bp, Mus musculus
ttttgcagggtttgagtaaggtatt

SEQ ID NO: 980231 - DNA, 25 bp, Mus musculus
ttttgcagtcggacttaaagaggat

SEQ ID NO: 980232 - DNA, 25 bp, Mus musculus
ttttgcagtcggtcttaaagaggat

SEQ ID NO: 980233 - DNA, 25 bp, Mus musculus
ttttgcagtctgagccaagtcaagc

SEQ ID NO: 980234 - DNA, 25 bp, Mus musculus
ttttgcagtctgctgtgcatgccat

SEQ ID NO: 980235 - DNA, 25 bp, Mus musculus
ttttgcagtctggtgtgcatgccat

SEQ ID NO: 980236 - DNA, 25 bp, Mus musculus
ttttgcagtctgtgccaagtcaagc

SEQ ID NO: 980237 - DNA, 25 bp, Mus musculus
ttttgcagttttactggccagtgaa

SEQ ID NO: 980238 - DNA, 25 bp, Mus musculus
ttttgcagtttttctggccagtgaa

SEQ ID NO: 980239 - DNA, 25 bp, Mus musculus
ttttgcatatgccaacgtctccaag

SEQ ID NO: 980240 - DNA, 25 bp, Mus musculus
ttttgcatatgcgaacgtctccaag

SEQ ID NO: 980241 - DNA, 25 bp, Mus musculus
ttttgcatattcattcaccgttttg

SEQ ID NO: 980242 - DNA, 25 bp, Mus musculus
ttttgcatattctttcaccgttttg

SEQ ID NO: 980243 - DNA, 25 bp, Mus musculus
ttttgcatatttcgactcagctatc

SEQ ID NO: 980244 - DNA, 25 bp, Mus musculus
ttttgcatatttggactcagctatc

SEQ ID NO: 980245 - DNA, 25 bp, Mus musculus
ttttgcatcatcaaaaatctcatga

SEQ ID NO: 980246 - DNA, 25 bp, Mus musculus
ttttgcatcatcactttctaaacac

SEQ ID NO: 980247 - DNA, 25 bp, Mus musculus
ttttgcatcatctaaaatctcatga

SEQ ID NO: 980248 - DNA, 25 bp, Mus musculus
ttttgcatcatctctttctaaacac

SEQ ID NO: 980249 - DNA, 25 bp, Mus musculus
ttttgcatcctcaccaatgctgctt

SEQ ID NO: 980250 - DNA, 25 bp, Mus musculus
ttttgcatcctctccaatgctgctt

SEQ ID NO: 980251 - DNA, 25 bp, Mus musculus
ttttgcatcgagatgggcacctcac

SEQ ID NO: 980252 - DNA, 25 bp, Mus musculus
ttttgcatcgagttgggcacctcac

SEQ ID NO: 980253 - DNA, 25 bp, Mus musculus
ttttgcatgctaatatttggactta

SEQ ID NO: 980254 - DNA, 25 bp, Mus musculus
ttttgcatgctattatttggactta

SEQ ID NO: 980255 - DNA, 25 bp, Mus musculus
ttttgcatgcttcaacctggctaat

SEQ ID NO: 980256 - DNA, 25 bp, Mus musculus
ttttgcatgcttgaacctggctaat

SEQ ID NO: 980257 - DNA, 25 bp, Mus musculus
ttttgcatgtgcaccaaactactcg

SEQ ID NO: 980258 - DNA, 25 bp, Mus musculus
ttttgcatgtgctccaaactactcg

SEQ ID NO: 980259 - DNA, 25 bp, Mus musculus
ttttgcatgtgtctacacatgattg

SEQ ID NO: 980260 - DNA, 25 bp, Mus musculus
ttttgcatgtgtgtacacatgattg

SEQ ID NO: 980261 - DNA, 25 bp, Mus musculus
ttttgcattaggcttagctgcctcc

SEQ ID NO: 980262 - DNA, 25 bp, Mus musculus
ttttgcattagggttagctgcctcc

SEQ ID NO: 980263 - DNA, 25 bp, Mus musculus
ttttgcattggtccctcgacccaat

SEQ ID NO: 980264 - DNA, 25 bp, Mus musculus
ttttgcattggtgcctcgacccaat

SEQ ID NO: 980265 - DNA, 25 bp, Mus musculus
ttttgcatttgtaattctttcttgg

SEQ ID NO: 980266 - DNA, 25 bp, Mus musculus
ttttgcatttgttattctttcttgg

SEQ ID NO: 980267 - DNA, 25 bp, Mus musculus
ttttgccaaatgctgcaggtactct

SEQ ID NO: 980268 - DNA, 25 bp, Mus musculus
ttttgccaaatggtgcaggtactct

SEQ ID NO: 980269 - DNA, 25 bp, Mus musculus
ttttgccaaccaactttcgaccctc

SEQ ID NO: 980270 - DNA, 25 bp, Mus musculus
ttttgccaaccatctttcgaccctc

SEQ ID NO: 980271 - DNA, 25 bp, Mus musculus
ttttgccacaccattatttattact

SEQ ID NO: 980272 - DNA, 25 bp, Mus musculus
ttttgccacacctttatttattact

SEQ ID NO: 980273 - DNA, 25 bp, Mus musculus
ttttgccacagcataatctggtttt

SEQ ID NO: 980274 - DNA, 25 bp, Mus musculus
ttttgccacagcttaatctggtttt

SEQ ID NO: 980275 - DNA, 25 bp, Mus musculus
ttttgccacggcacatgtacacgga

SEQ ID NO: 980276 - DNA, 25 bp, Mus musculus
ttttgccacggctcatgtacacgga

SEQ ID NO: 980277 - DNA, 25 bp, Mus musculus
ttttgccagtctccgaatggcccgt

SEQ ID NO: 980278 - DNA, 25 bp, Mus musculus
ttttgccagtctgcgaatggcccgt

SEQ ID NO: 980279 - DNA, 25 bp, Mus musculus
ttttgccatatcacttttccacatt

SEQ ID NO: 980280 - DNA, 25 bp, Mus musculus
ttttgccatatctcttttccacatt

SEQ ID NO: 980281 - DNA, 25 bp, Mus musculus
ttttgccatattcagcttagcttgc

SEQ ID NO: 980282 - DNA, 25 bp, Mus musculus
ttttgccatattgagcttagcttgc

SEQ ID NO: 980283 - DNA, 25 bp, Mus musculus
ttttgccatcaaaatgaggcctgtg

SEQ ID NO: 980284 - DNA, 25 bp, Mus musculus
ttttgccatcaatatgaggcctgtg

SEQ ID NO: 980285 - DNA, 25 bp, Mus musculus
ttttgccattcgctcctcttctctt

SEQ ID NO: 980286 - DNA, 25 bp, Mus musculus
ttttgccattcggtcctcttctctt

SEQ ID NO: 980287 - DNA, 25 bp, Mus musculus
ttttgcccaactaggattgccagtt

SEQ ID NO: 980288 - DNA, 25 bp, Mus musculus
ttttgcccaacttggattgccagtt

SEQ ID NO: 980289 - DNA, 25 bp, Mus musculus
ttttgcccacaaaagcatacctgat

SEQ ID NO: 980290 - DNA, 25 bp, Mus musculus
ttttgcccacaacgtgctcaactag

SEQ ID NO: 980291 - DNA, 25 bp, Mus musculus
ttttgcccacaaggtgctcaactag

SEQ ID NO: 980292 - DNA, 25 bp, Mus musculus
ttttgcccacaatagcatacctgat

SEQ ID NO: 980293 - DNA, 25 bp, Mus musculus
ttttgcccaccaatgcttatacgta

SEQ ID NO: 980294 - DNA, 25 bp, Mus musculus
ttttgcccaccattgcttatacgta

SEQ ID NO: 980295 - DNA, 25 bp, Mus musculus
ttttgcccagccagataaacaggat

SEQ ID NO: 980296 - DNA, 25 bp, Mus musculus
ttttgcccagcctgataaacaggat

SEQ ID NO: 980297 - DNA, 25 bp, Mus musculus
ttttgcccagctcgtaagtgtcatg

SEQ ID NO: 980298 - DNA, 25 bp, Mus musculus
ttttgcccagctggtaagtgtcatg

SEQ ID NO: 980299 - DNA, 25 bp, Mus musculus
ttttgcccagtaaccagtttctgag

SEQ ID NO: 980300 - DNA, 25 bp, Mus musculus
ttttgcccagtatccagtttctgag

SEQ ID NO: 980301 - DNA, 25 bp, Mus musculus
ttttgcccatagagccattagtaga

SEQ ID NO: 980302 - DNA, 25 bp, Mus musculus
ttttgcccatagtgccattagtaga

SEQ ID NO: 980303 - DNA, 25 bp, Mus musculus
ttttgccccagaactgaattttgga

SEQ ID NO: 980304 - DNA, 25 bp, Mus musculus
ttttgccccagatctgaattttgga

SEQ ID NO: 980305 - DNA, 25 bp, Mus musculus
ttttgccccatgacagtgatcctgt

SEQ ID NO: 980306 - DNA, 25 bp, Mus musculus
ttttgccccatgtcagtgatcctgt

SEQ ID NO: 980307 - DNA, 25 bp, Mus musculus
ttttgcccctgtagaaatgtttagc

SEQ ID NO: 980308 - DNA, 25 bp, Mus musculus
ttttgcccctgttgaaatgtttagc

SEQ ID NO: 980309 - DNA, 25 bp, Mus musculus
ttttgcccgacgaccattcattcaa

SEQ ID NO: 980310 - DNA, 25 bp, Mus musculus
ttttgcccgacgtccattcattcaa

SEQ ID NO: 980311 - DNA, 25 bp, Mus musculus
ttttgcccgctgaccagataacatt

SEQ ID NO: 980312 - DNA, 25 bp, Mus musculus
ttttgcccgctgtccagataacatt

SEQ ID NO: 980313 - DNA, 25 bp, Mus musculus
ttttgccctaacaaccataagctcc

SEQ ID NO: 980314 - DNA, 25 bp, Mus musculus
ttttgccctaactaccataagctcc

SEQ ID NO: 980315 - DNA, 25 bp, Mus musculus
ttttgccctgctcatagtactaaac

SEQ ID NO: 980316 - DNA, 25 bp, Mus musculus
ttttgccctgctgatagtactaaac

SEQ ID NO: 980317 - DNA, 25 bp, Mus musculus
ttttgccctggtaggataggctcta

SEQ ID NO: 980318 - DNA, 25 bp, Mus musculus
ttttgccctggttggataggctcta

SEQ ID NO: 980319 - DNA, 25 bp, Mus musculus
ttttgcccttgtccctagttaagag

SEQ ID NO: 980320 - DNA, 25 bp, Mus musculus
ttttgcccttgtgcctagttaagag

SEQ ID NO: 980321 - DNA, 25 bp, Mus musculus
ttttgccggagtccaggataccgcc

SEQ ID NO: 980322 - DNA, 25 bp, Mus musculus
ttttgccggagtgcaggataccgcc

SEQ ID NO: 980323 - DNA, 25 bp, Mus musculus
ttttgcctagaaaggagatcctgga

SEQ ID NO: 980324 - DNA, 25 bp, Mus musculus
ttttgcctagaatggagatcctgga

SEQ ID NO: 980325 - DNA, 25 bp, Mus musculus
ttttgcctcactcagccgtgactca

SEQ ID NO: 980326 - DNA, 25 bp, Mus musculus
ttttgcctcactgagccgtgactca

SEQ ID NO: 980327 - DNA, 25 bp, Mus musculus
ttttgcctcagaactactgggactg

SEQ ID NO: 980328 - DNA, 25 bp, Mus musculus
ttttgcctcagatctactgggactg

SEQ ID NO: 980329 - DNA, 25 bp, Mus musculus
ttttgcctcatgaatgttcagacat

SEQ ID NO: 980330 - DNA, 25 bp, Mus musculus
ttttgcctcatgctcaagaaaggag

SEQ ID NO: 980331 - DNA, 25 bp, Mus musculus
ttttgcctcatggtcaagaaaggag

SEQ ID NO: 980332 - DNA, 25 bp, Mus musculus
ttttgcctcatgtatgttcagacat

SEQ ID NO: 980333 - DNA, 25 bp, Mus musculus
ttttgcctcattcacttgtactgta

SEQ ID NO: 980334 - DNA, 25 bp, Mus musculus
ttttgcctcattgacttgtactgta

SEQ ID NO: 980335 - DNA, 25 bp, Mus musculus
ttttgcctcggtcgaagtgtgagca

SEQ ID NO: 980336 - DNA, 25 bp, Mus musculus
ttttgcctcggtggaagtgtgagca

SEQ ID NO: 980337 - DNA, 25 bp, Mus musculus
ttttgcctctgaactgctaattcca

SEQ ID NO: 980338 - DNA, 25 bp, Mus musculus
ttttgcctctgatctgctaattcca

SEQ ID NO: 980339 - DNA, 25 bp, Mus musculus
ttttgcctcttgcttggcgagagtc

SEQ ID NO: 980340 - DNA, 25 bp, Mus musculus
ttttgcctcttggttggcgagagtc

SEQ ID NO: 980341 - DNA, 25 bp, Mus musculus
ttttgcctctttcacgggagcagga

SEQ ID NO: 980342 - DNA, 25 bp, Mus musculus
ttttgcctctttgacgggagcagga

SEQ ID NO: 980343 - DNA, 25 bp, Mus musculus
ttttgcctgagccatttttgggctc

SEQ ID NO: 980344 - DNA, 25 bp, Mus musculus
ttttgcctgagcgatttttgggctc

SEQ ID NO: 980345 - DNA, 25 bp, Mus musculus
ttttgcctgcatccaaggcacctag

SEQ ID NO: 980346 - DNA, 25 bp, Mus musculus
ttttgcctgcatgcaaggcacctag

SEQ ID NO: 980347 - DNA, 25 bp, Mus musculus
ttttgcctggaaatgcccttgcttt

SEQ ID NO: 980348 - DNA, 25 bp, Mus musculus
ttttgcctggaattgcccttgcttt

SEQ ID NO: 980349 - DNA, 25 bp, Mus musculus
ttttgcctgggaacctgacactcaa

SEQ ID NO: 980350 - DNA, 25 bp, Mus musculus
ttttgcctgggatcctgacactcaa

SEQ ID NO: 980351 - DNA, 25 bp, Mus musculus
ttttgcctgtgcatcctaaggctag

SEQ ID NO: 980352 - DNA, 25 bp, Mus musculus
ttttgcctgtgcttcctaaggctag

SEQ ID NO: 980353 - DNA, 25 bp, Mus musculus
ttttgcctgtgtctaaccgggtttg

SEQ ID NO: 980354 - DNA, 25 bp, Mus musculus
ttttgcctgtgtgtaaccgggtttg

SEQ ID NO: 980355 - DNA, 25 bp, Mus musculus
ttttgcctgttccagtctaaaacca

SEQ ID NO: 980356 - DNA, 25 bp, Mus musculus
ttttgcctgttcgagtctaaaacca

SEQ ID NO: 980357 - DNA, 25 bp, Mus musculus
ttttgccttcacacatcttatggga

SEQ ID NO: 980358 - DNA, 25 bp, Mus musculus
ttttgccttcactcatcttatggga

SEQ ID NO: 980359 - DNA, 25 bp, Mus musculus
ttttgccttctcaaataggccacta

SEQ ID NO: 980360 - DNA, 25 bp, Mus musculus
ttttgccttctctaataggccacta

SEQ ID NO: 980361 - DNA, 25 bp, Mus musculus
ttttgccttgtcctcaccagtaatt

SEQ ID NO: 980362 - DNA, 25 bp, Mus musculus
ttttgccttgtcgtcaccagtaatt

SEQ ID NO: 980363 - DNA, 25 bp, Mus musculus
ttttgcctttaacgacatggccaag

SEQ ID NO: 980364 - DNA, 25 bp, Mus musculus
ttttgcctttaaggacatggccaag

SEQ ID NO: 980365 - DNA, 25 bp, Mus musculus
ttttgcctttgaaacaactaagtta

SEQ ID NO: 980366 - DNA, 25 bp, Mus musculus
ttttgcctttgatacaactaagtta

SEQ ID NO: 980367 - DNA, 25 bp, Mus musculus
ttttgcgatgctctctagatctttc

SEQ ID NO: 980368 - DNA, 25 bp, Mus musculus
ttttgcgatgctgtctagatctttc

SEQ ID NO: 980369 - DNA, 25 bp, Mus musculus
ttttgcgattctcttttatactccc

SEQ ID NO: 980370 - DNA, 25 bp, Mus musculus
ttttgcgattctgttttatactccc

SEQ ID NO: 980371 - DNA, 25 bp, Mus musculus
ttttgcgcagttccacatttgtggg

SEQ ID NO: 980372 - DNA, 25 bp, Mus musculus
ttttgcgcagttgcacatttgtggg

SEQ ID NO: 980373 - DNA, 25 bp, Mus musculus
ttttgcgccaagatcctttcaagaa

SEQ ID NO: 980374 - DNA, 25 bp, Mus musculus
ttttgcgccaagttcctttcaagaa

SEQ ID NO: 980375 - DNA, 25 bp, Mus musculus
ttttgcgctgaacgatgaccacatc

SEQ ID NO: 980376 - DNA, 25 bp, Mus musculus
ttttgcgctgaaggatgaccacatc

SEQ ID NO: 980377 - DNA, 25 bp, Mus musculus
ttttgcggaaatcagcctggcgtct

SEQ ID NO: 980378 - DNA, 25 bp, Mus musculus
ttttgcggaaatgagcctggcgtct

SEQ ID NO: 980379 - DNA, 25 bp, Mus musculus
ttttgcggatagctacattgactcc

SEQ ID NO: 980380 - DNA, 25 bp, Mus musculus
ttttgcggataggtacattgactcc

SEQ ID NO: 980381 - DNA, 25 bp, Mus musculus
ttttgcggcgtcacttgtacctcag

SEQ ID NO: 980382 - DNA, 25 bp, Mus musculus
ttttgcggcgtctcttgtacctcag

SEQ ID NO: 980383 - DNA, 25 bp, Mus musculus
ttttgcgtgcacacaaggtggacca

SEQ ID NO: 980384 - DNA, 25 bp, Mus musculus
ttttgcgtgcactcaaggtggacca

SEQ ID NO: 980385 - DNA, 25 bp, Mus musculus
ttttgcgtttagatcacatgagagc

SEQ ID NO: 980386 - DNA, 25 bp, Mus musculus
ttttgcgtttagttcacatgagagc

SEQ ID NO: 980387 - DNA, 25 bp, Mus musculus
ttttgctaaacccaaaggtcctgcg

SEQ ID NO: 980388 - DNA, 25 bp, Mus musculus
ttttgctaaaccgaaaggtcctgcg

SEQ ID NO: 980389 - DNA, 25 bp, Mus musculus
ttttgctaatctatgctatcagtat

SEQ ID NO: 980390 - DNA, 25 bp, Mus musculus
ttttgctaatctttgctatcagtat

SEQ ID NO: 980391 - DNA, 25 bp, Mus musculus
ttttgctacaaaccgcctgagtaag

SEQ ID NO: 980392 - DNA, 25 bp, Mus musculus
ttttgctacaaagcgcctgagtaag

SEQ ID NO: 980393 - DNA, 25 bp, Mus musculus
ttttgctaccagattcattgaattg

SEQ ID NO: 980394 - DNA, 25 bp, Mus musculus
ttttgctaccagtttcattgaattg

SEQ ID NO: 980395 - DNA, 25 bp, Mus musculus
ttttgctatgcgctgtactgtgtag

SEQ ID NO: 980396 - DNA, 25 bp, Mus musculus
ttttgctatgcggtgtactgtgtag

SEQ ID NO: 980397 - DNA, 25 bp, Mus musculus
ttttgctatgtcacaaactggcccg

SEQ ID NO: 980398 - DNA, 25 bp, Mus musculus
ttttgctatgtctcaaactggcccg

SEQ ID NO: 980399 - DNA, 25 bp, Mus musculus
ttttgctcagtaaaagttcttacgt

SEQ ID NO: 980400 - DNA, 25 bp, Mus musculus
ttttgctcagtataagttcttacgt

SEQ ID NO: 980401 - DNA, 25 bp, Mus musculus
ttttgctcagtgcttgccagactcc

SEQ ID NO: 980402 - DNA, 25 bp, Mus musculus
ttttgctcagtggttgccagactcc

SEQ ID NO: 980403 - DNA, 25 bp, Mus musculus
ttttgctccctaaatagatggcatt

SEQ ID NO: 980404 - DNA, 25 bp, Mus musculus
ttttgctccctatatagatggcatt

SEQ ID NO: 980405 - DNA, 25 bp, Mus musculus
ttttgctctgaaatcctataggtgg

SEQ ID NO: 980406 - DNA, 25 bp, Mus musculus
ttttgctctgaattcctataggtgg

SEQ ID NO: 980407 - DNA, 25 bp, Mus musculus
ttttgctctgaccttcctgtttcaa

SEQ ID NO: 980408 - DNA, 25 bp, Mus musculus
ttttgctctgacgttcctgtttcaa

SEQ ID NO: 980409 - DNA, 25 bp, Mus musculus
ttttgctgaaagacttactgggtaa

SEQ ID NO: 980410 - DNA, 25 bp, Mus musculus
ttttgctgaaagtcttactgggtaa

SEQ ID NO: 980411 - DNA, 25 bp, Mus musculus
ttttgctgatggaacatggtgcccc

SEQ ID NO: 980412 - DNA, 25 bp, Mus musculus
ttttgctgatggtacatggtgcccc

SEQ ID NO: 980413 - DNA, 25 bp, Mus musculus
ttttgctgcaagagaccaacctggg

SEQ ID NO: 980414 - DNA, 25 bp, Mus musculus
ttttgctgcaagtgaccaacctggg

SEQ ID NO: 980415 - DNA, 25 bp, Mus musculus
ttttgctgcagcagtggacagtaga

SEQ ID NO: 980416 - DNA, 25 bp, Mus musculus
ttttgctgcagctgtggacagtaga

SEQ ID NO: 980417 - DNA, 25 bp, Mus musculus
ttttgctgcatccactttgctggtg

SEQ ID NO: 980418 - DNA, 25 bp, Mus musculus
ttttgctgcatcgactttgctggtg

SEQ ID NO: 980419 - DNA, 25 bp, Mus musculus
ttttgctgcctgatgctctgagatc

SEQ ID NO: 980420 - DNA, 25 bp, Mus musculus
ttttgctgcctgttgctctgagatc

SEQ ID NO: 980421 - DNA, 25 bp, Mus musculus
ttttgctgctataagagttttctga

SEQ ID NO: 980422 - DNA, 25 bp, Mus musculus
ttttgctgctattagagttttctga

SEQ ID NO: 980423 - DNA, 25 bp, Mus musculus
ttttgctgctctcttctgcattgac

SEQ ID NO: 980424 - DNA, 25 bp, Mus musculus
ttttgctgctctgttctgcattgac

SEQ ID NO: 980425 - DNA, 25 bp, Mus musculus
ttttgctgctgacttaatcacacac

SEQ ID NO: 980426 - DNA, 25 bp, Mus musculus
ttttgctgctgagttaatcacacac

SEQ ID NO: 980427 - DNA, 25 bp, Mus musculus
ttttgctgctgtaatggggacccct

SEQ ID NO: 980428 - DNA, 25 bp, Mus musculus
ttttgctgctgttatggggacccct

SEQ ID NO: 980429 - DNA, 25 bp, Mus musculus
ttttgctgctttagcaagggaacct

SEQ ID NO: 980430 - DNA, 25 bp, Mus musculus
ttttgctgcttttgcaagggaacct

SEQ ID NO: 980431 - DNA, 25 bp, Mus musculus
ttttgctggcaaagcattgttgcat

SEQ ID NO: 980432 - DNA, 25 bp, Mus musculus
ttttgctggcaatgcattgttgcat

SEQ ID NO: 980433 - DNA, 25 bp, Mus musculus
ttttgctggtgtcttgctcctggaa

SEQ ID NO: 980434 - DNA, 25 bp, Mus musculus
ttttgctggtgtgttgctcctggaa

SEQ ID NO: 980435 - DNA, 25 bp, Mus musculus
ttttgctgtgccagtatcggaacat

SEQ ID NO: 980436 - DNA, 25 bp, Mus musculus
ttttgctgtgcctgtatcggaacat

SEQ ID NO: 980437 - DNA, 25 bp, Mus musculus
ttttgctgtggaccgcctacctgta

SEQ ID NO: 980438 - DNA, 25 bp, Mus musculus
ttttgctgtggagcgcctacctgta

SEQ ID NO: 980439 - DNA, 25 bp, Mus musculus
ttttgctgttacctctttgttccca

SEQ ID NO: 980440 - DNA, 25 bp, Mus musculus
ttttgctgttacgtctttgttccca

SEQ ID NO: 980441 - DNA, 25 bp, Mus musculus
ttttgctgttgtacttactgctaac

SEQ ID NO: 980442 - DNA, 25 bp, Mus musculus
ttttgctgttgttcttactgctaac

SEQ ID NO: 980443 - DNA, 25 bp, Mus musculus
ttttgcttaagacagaccagtagtt

SEQ ID NO: 980444 - DNA, 25 bp, Mus musculus
ttttgcttaagagagaccagtagtt

SEQ ID NO: 980445 - DNA, 25 bp, Mus musculus
ttttgcttacacatgtgcctatgta

SEQ ID NO: 980446 - DNA, 25 bp, Mus musculus
ttttgcttacacttgtgcctatgta

SEQ ID NO: 980447 - DNA, 25 bp, Mus musculus
ttttgcttagtaccgacagtgcccg

SEQ ID NO: 980448 - DNA, 25 bp, Mus musculus
ttttgcttagtagcgacagtgcccg

SEQ ID NO: 980449 - DNA, 25 bp, Mus musculus
ttttgcttccctatcatgcttttgg

SEQ ID NO: 980450 - DNA, 25 bp, Mus musculus
ttttgcttccctttcatgcttttgg

SEQ ID NO: 980451 - DNA, 25 bp, Mus musculus
ttttgcttcgggaccgctgcagagg

SEQ ID NO: 980452 - DNA, 25 bp, Mus musculus
ttttgcttcgggtccgctgcagagg

SEQ ID NO: 980453 - DNA, 25 bp, Mus musculus
ttttgcttctctaaaccattgccca

SEQ ID NO: 980454 - DNA, 25 bp, Mus musculus
ttttgcttctcttaaccattgccca

SEQ ID NO: 980455 - DNA, 25 bp, Mus musculus
ttttgcttcttgattagttctcata

SEQ ID NO: 980456 - DNA, 25 bp, Mus musculus
ttttgcttcttgtttagttctcata

SEQ ID NO: 980457 - DNA, 25 bp, Mus musculus
ttttgcttgatccaggagacacaga

SEQ ID NO: 980458 - DNA, 25 bp, Mus musculus
ttttgcttgatcgaggagacacaga

SEQ ID NO: 980459 - DNA, 25 bp, Mus musculus
ttttgcttggaacctgggtcttgca

SEQ ID NO: 980460 - DNA, 25 bp, Mus musculus
ttttgcttggaagctgggtcttgca

SEQ ID NO: 980461 - DNA, 25 bp, Mus musculus
ttttgcttgtacactgccactcttt

SEQ ID NO: 980462 - DNA, 25 bp, Mus musculus
ttttgcttgtactctgccactcttt

SEQ ID NO: 980463 - DNA, 25 bp, Mus musculus
ttttgcttgtagacagggtgctgtg

SEQ ID NO: 980464 - DNA, 25 bp, Mus musculus
ttttgcttgtagtcagggtgctgtg

SEQ ID NO: 980465 - DNA, 25 bp, Mus musculus
ttttgcttgtatcatgggcttcctt

SEQ ID NO: 980466 - DNA, 25 bp, Mus musculus
ttttgcttgtatctctatcacttga

SEQ ID NO: 980467 - DNA, 25 bp, Mus musculus
ttttgcttgtatgatgggcttcctt

SEQ ID NO: 980468 - DNA, 25 bp, Mus musculus
ttttgcttgtatgtctatcacttga

SEQ ID NO: 980469 - DNA, 25 bp, Mus musculus
ttttgcttgttactgaaatgaccat

SEQ ID NO: 980470 - DNA, 25 bp, Mus musculus
ttttgcttgttagtgaaatgaccat

SEQ ID NO: 980471 - DNA, 25 bp, Mus musculus
ttttgctttaaccttccagacaaga

SEQ ID NO: 980472 - DNA, 25 bp, Mus musculus
ttttgctttaacgttccagacaaga

SEQ ID NO: 980473 - DNA, 25 bp, Mus musculus
ttttgctttacacgacccgtcgaga

SEQ ID NO: 980474 - DNA, 25 bp, Mus musculus
ttttgctttacaggacccgtcgaga

SEQ ID NO: 980475 - DNA, 25 bp, Mus musculus
ttttgctttattcctctgaaatcag

SEQ ID NO: 980476 - DNA, 25 bp, Mus musculus
ttttgctttattgctctgaaatcag

SEQ ID NO: 980477 - DNA, 25 bp, Mus musculus
ttttgctttcaaaattgcctatctt

SEQ ID NO: 980478 - DNA, 25 bp, Mus musculus
ttttgctttcaatattgcctatctt

SEQ ID NO: 980479 - DNA, 25 bp, Mus musculus
ttttgctttcctccgtctagtgaaa

SEQ ID NO: 980480 - DNA, 25 bp, Mus musculus
ttttgctttcctgcgtctagtgaaa

SEQ ID NO: 980481 - DNA, 25 bp, Mus musculus
ttttgctttctcaggaatgtagact

SEQ ID NO: 980482 - DNA, 25 bp, Mus musculus
ttttgctttctctggaatgtagact

SEQ ID NO: 980483 - DNA, 25 bp, Mus musculus
ttttgctttgcaattctgcacacac

SEQ ID NO: 980484 - DNA, 25 bp, Mus musculus
ttttgctttgcatttctgcacacac

SEQ ID NO: 980485 - DNA, 25 bp, Mus musculus
ttttgctttgccactgtgctttact

SEQ ID NO: 980486 - DNA, 25 bp, Mus musculus
ttttgctttgcctctgtgctttact

SEQ ID NO: 980487 - DNA, 25 bp, Mus musculus
ttttgctttgctatctcagacaggt

SEQ ID NO: 980488 - DNA, 25 bp, Mus musculus
ttttgctttgctttctcagacaggt

SEQ ID NO: 980489 - DNA, 25 bp, Mus musculus
ttttgcttttcaactgctaccatga

SEQ ID NO: 980490 - DNA, 25 bp, Mus musculus
ttttgcttttcatctgctaccatga

SEQ ID NO: 980491 - DNA, 25 bp, Mus musculus
ttttgcttttctcactaaccatact

SEQ ID NO: 980492 - DNA, 25 bp, Mus musculus
ttttgcttttctgactaaccatact

SEQ ID NO: 980493 - DNA, 25 bp, Mus musculus
ttttgctttttaaaccatctattgg

SEQ ID NO: 980494 - DNA, 25 bp, Mus musculus
ttttgctttttataccatctattgg

SEQ ID NO: 980495 - DNA, 25 bp, Mus musculus
ttttgcttttttcacacttccttgg

SEQ ID NO: 980496 - DNA, 25 bp, Mus musculus
ttttgcttttttgacacttccttgg

SEQ ID NO: 980497 - DNA, 25 bp, Mus musculus
ttttggaaattacactgagcccctt

SEQ ID NO: 980498 - DNA, 25 bp, Mus musculus
ttttggaaattagactgagcccctt

SEQ ID NO: 980499 - DNA, 25 bp, Mus musculus
ttttggaacaggctcccccagcttc

SEQ ID NO: 980500 - DNA, 25 bp, Mus musculus
ttttggaacagggtcccccagcttc

SEQ ID NO: 980501 - DNA, 25 bp, Mus musculus
ttttggaaccagaacgccgctgcca

SEQ ID NO: 980502 - DNA, 25 bp, Mus musculus
ttttggaaccagtacgccgctgcca

SEQ ID NO: 980503 - DNA, 25 bp, Mus musculus
ttttggaacctgacagatgcagcta

SEQ ID NO: 980504 - DNA, 25 bp, Mus musculus
ttttggaacctgcttacctcactca

SEQ ID NO: 980505 - DNA, 25 bp, Mus musculus
ttttggaacctggttacctcactca

SEQ ID NO: 980506 - DNA, 25 bp, Mus musculus
ttttggaacctgtcagatgcagcta

SEQ ID NO: 980507 - DNA, 25 bp, Mus musculus
ttttggaacgttatttggcattgca

SEQ ID NO: 980508 - DNA, 25 bp, Mus musculus
ttttggaacgttttttggcattgca

SEQ ID NO: 980509 - DNA, 25 bp, Mus musculus
ttttggaactcaaaaggctgacctc

SEQ ID NO: 980510 - DNA, 25 bp, Mus musculus
ttttggaactcataaggctgacctc

SEQ ID NO: 980511 - DNA, 25 bp, Mus musculus
ttttggaaggctctactgtgtactc

SEQ ID NO: 980512 - DNA, 25 bp, Mus musculus
ttttggaaggctgtactgtgtactc

SEQ ID NO: 980513 - DNA, 25 bp, Mus musculus
ttttggaagtacatacactgggact

SEQ ID NO: 980514 - DNA, 25 bp, Mus musculus
ttttggaagtacttacactgggact

SEQ ID NO: 980515 - DNA, 25 bp, Mus musculus
ttttggaatcacaccctgaaaacaa

SEQ ID NO: 980516 - DNA, 25 bp, Mus musculus
ttttggaatcactccctgaaaacaa

SEQ ID NO: 980517 - DNA, 25 bp, Mus musculus
ttttggaatccgctgtggcacacac

SEQ ID NO: 980518 - DNA, 25 bp, Mus musculus
ttttggaatccggtgtggcacacac

SEQ ID NO: 980519 - DNA, 25 bp, Mus musculus
ttttggaatgctacatctgtccctt

SEQ ID NO: 980520 - DNA, 25 bp, Mus musculus
ttttggaatgcttcatctgtccctt

SEQ ID NO: 980521 - DNA, 25 bp, Mus musculus
ttttggaatgtcacagttttacaag

SEQ ID NO: 980522 - DNA, 25 bp, Mus musculus
ttttggaatgtctcagttttacaag

SEQ ID NO: 980523 - DNA, 25 bp, Mus musculus
ttttggaatttaccggctgagagat

SEQ ID NO: 980524 - DNA, 25 bp, Mus musculus
ttttggaatttagcggctgagagat

SEQ ID NO: 980525 - DNA, 25 bp, Mus musculus
ttttggacaatgagaaactaatttg

SEQ ID NO: 980526 - DNA, 25 bp, Mus musculus
ttttggacaatgtgaaactaatttg

SEQ ID NO: 980527 - DNA, 25 bp, Mus musculus
ttttggacagacacatcagcacgaa

SEQ ID NO: 980528 - DNA, 25 bp, Mus musculus
ttttggacagactcatcagcacgaa

SEQ ID NO: 980529 - DNA, 25 bp, Mus musculus
ttttggacaggcctgaaaacccatg

SEQ ID NO: 980530 - DNA, 25 bp, Mus musculus
ttttggacaggcgtgaaaacccatg

SEQ ID NO: 980531 - DNA, 25 bp, Mus musculus
ttttggaccaccaaggcatttctcc

SEQ ID NO: 980532 - DNA, 25 bp, Mus musculus
ttttggaccaccacaggcatgtttc

SEQ ID NO: 980533 - DNA, 25 bp, Mus musculus
ttttggaccacctaggcatttctcc

SEQ ID NO: 980534 - DNA, 25 bp, Mus musculus
ttttggaccacctcaggcatgtttc

SEQ ID NO: 980535 - DNA, 25 bp, Mus musculus
ttttggaccccaacgaaatgttaga

SEQ ID NO: 980536 - DNA, 25 bp, Mus musculus
ttttggaccccatcgaaatgttaga

SEQ ID NO: 980537 - DNA, 25 bp, Mus musculus
ttttggaccttaatgcagctattca

SEQ ID NO: 980538 - DNA, 25 bp, Mus musculus
ttttggaccttattgcagctattca

SEQ ID NO: 980539 - DNA, 25 bp, Mus musculus
ttttggacgcatactgttttctgtt

SEQ ID NO: 980540 - DNA, 25 bp, Mus musculus
ttttggacgcattctgttttctgtt

SEQ ID NO: 980541 - DNA, 25 bp, Mus musculus
ttttggagacttaggccgcccagga

SEQ ID NO: 980542 - DNA, 25 bp, Mus musculus
ttttggagactttggccgcccagga

SEQ ID NO: 980543 - DNA, 25 bp, Mus musculus
ttttggagatgccagaaccatggag

SEQ ID NO: 980544 - DNA, 25 bp, Mus musculus
ttttggagatgcgagaaccatggag

SEQ ID NO: 980545 - DNA, 25 bp, Mus musculus
ttttggagcaccactatcccttagg

SEQ ID NO: 980546 - DNA, 25 bp, Mus musculus
ttttggagcacctctatcccttagg

SEQ ID NO: 980547 - DNA, 25 bp, Mus musculus
ttttggagccttcctcgctgagcga

SEQ ID NO: 980548 - DNA, 25 bp, Mus musculus
ttttggagccttgctcgctgagcga

SEQ ID NO: 980549 - DNA, 25 bp, Mus musculus
ttttggagctgtctaccaggcactc

SEQ ID NO: 980550 - DNA, 25 bp, Mus musculus
ttttggagctgtgtaccaggcactc

SEQ ID NO: 980551 - DNA, 25 bp, Mus musculus
ttttggaggactacgtgcttgcttg

SEQ ID NO: 980552 - DNA, 25 bp, Mus musculus
ttttggaggacttcgtgcttgcttg

SEQ ID NO: 980553 - DNA, 25 bp, Mus musculus
ttttggagtagaattatcgcccgaa

SEQ ID NO: 980554 - DNA, 25 bp, Mus musculus
ttttggagtagatttatcgcccgaa

SEQ ID NO: 980555 - DNA, 25 bp, Mus musculus
ttttggagtcagattgttcagggtc

SEQ ID NO: 980556 - DNA, 25 bp, Mus musculus
ttttggagtcagtttgttcagggtc

SEQ ID NO: 980557 - DNA, 25 bp, Mus musculus
ttttggagtccaaccatctatgctc

SEQ ID NO: 980558 - DNA, 25 bp, Mus musculus
ttttggagtccatccatctatgctc

SEQ ID NO: 980559 - DNA, 25 bp, Mus musculus
ttttggatataacctgggccagcca

SEQ ID NO: 980560 - DNA, 25 bp, Mus musculus
ttttggatataagctgggccagcca

SEQ ID NO: 980561 - DNA, 25 bp, Mus musculus
ttttggatattcagacaggagctat

SEQ ID NO: 980562 - DNA, 25 bp, Mus musculus
ttttggatattctgacaggagctat

SEQ ID NO: 980563 - DNA, 25 bp, Mus musculus
ttttggatcaatcctctctgcagag

SEQ ID NO: 980564 - DNA, 25 bp, Mus musculus
ttttggatcaatgctctctgcagag

SEQ ID NO: 980565 - DNA, 25 bp, Mus musculus
ttttggatcggacgcttggtgccca

SEQ ID NO: 980566 - DNA, 25 bp, Mus musculus
ttttggatcggaggcttggtgccca

SEQ ID NO: 980567 - DNA, 25 bp, Mus musculus
ttttggatgccacgctgtctgctgc

SEQ ID NO: 980568 - DNA, 25 bp, Mus musculus
ttttggatgccaggctgtctgctgc

SEQ ID NO: 980569 - DNA, 25 bp, Mus musculus
ttttggatgctgcatcttctaccgt

SEQ ID NO: 980570 - DNA, 25 bp, Mus musculus
ttttggatgctggatcttctaccgt

SEQ ID NO: 980571 - DNA, 25 bp, Mus musculus
ttttggattccaatagtgtggctac

SEQ ID NO: 980572 - DNA, 25 bp, Mus musculus
ttttggattccattagtgtggctac

SEQ ID NO: 980573 - DNA, 25 bp, Mus musculus
ttttggattgccagtgctaacccag

SEQ ID NO: 980574 - DNA, 25 bp, Mus musculus
ttttggattgcctgtgctaacccag

SEQ ID NO: 980575 - DNA, 25 bp, Mus musculus
ttttggattgctcccaattcctggg

SEQ ID NO: 980576 - DNA, 25 bp, Mus musculus
ttttggattgctgccaattcctggg

SEQ ID NO: 980577 - DNA, 25 bp, Mus musculus
ttttggattgtgatcttgctgccac

SEQ ID NO: 980578 - DNA, 25 bp, Mus musculus
ttttggattgtgttcttgctgccac

SEQ ID NO: 980579 - DNA, 25 bp, Mus musculus
ttttggcaaaggagcttgtctagca

SEQ ID NO: 980580 - DNA, 25 bp, Mus musculus
ttttggcaaaggtgcttgtctagca

SEQ ID NO: 980581 - DNA, 25 bp, Mus musculus
ttttggcaacatccctgttttcggg

SEQ ID NO: 980582 - DNA, 25 bp, Mus musculus
ttttggcaacatgcctgttttcggg

SEQ ID NO: 980583 - DNA, 25 bp, Mus musculus
ttttggcacatgaatgataaaaaca

SEQ ID NO: 980584 - DNA, 25 bp, Mus musculus
ttttggcacatgtatgataaaaaca

SEQ ID NO: 980585 - DNA, 25 bp, Mus musculus
ttttggcacattagaggcttaaata

SEQ ID NO: 980586 - DNA, 25 bp, Mus musculus
ttttggcacattatttactgagcag

SEQ ID NO: 980587 - DNA, 25 bp, Mus musculus
ttttggcacatttgaggcttaaata

SEQ ID NO: 980588 - DNA, 25 bp, Mus musculus
ttttggcacattttttactgagcag

SEQ ID NO: 980589 - DNA, 25 bp, Mus musculus
ttttggcaccataacacatactgct

SEQ ID NO: 980590 - DNA, 25 bp, Mus musculus
ttttggcaccattacacatactgct

SEQ ID NO: 980591 - DNA, 25 bp, Mus musculus
ttttggcaccggcttgagccacgtg

SEQ ID NO: 980592 - DNA, 25 bp, Mus musculus
ttttggcaccgggttgagccacgtg

SEQ ID NO: 980593 - DNA, 25 bp, Mus musculus
ttttggcactggatacctcactaag

SEQ ID NO: 980594 - DNA, 25 bp, Mus musculus
ttttggcactggttacctcactaag

SEQ ID NO: 980595 - DNA, 25 bp, Mus musculus
ttttggcagccaattcaagttctat

SEQ ID NO: 980596 - DNA, 25 bp, Mus musculus
ttttggcagccatttcaagttctat

SEQ ID NO: 980597 - DNA, 25 bp, Mus musculus
ttttggcagcgaagacacagaaact

SEQ ID NO: 980598 - DNA, 25 bp, Mus musculus
ttttggcagcgatgacacagaaact

SEQ ID NO: 980599 - DNA, 25 bp, Mus musculus
ttttggcagctgaggtttgggtcat

SEQ ID NO: 980600 - DNA, 25 bp, Mus musculus
ttttggcagctgtggtttgggtcat

SEQ ID NO: 980601 - DNA, 25 bp, Mus musculus
ttttggcatagcagtcatttctcac

SEQ ID NO: 980602 - DNA, 25 bp, Mus musculus
ttttggcatagctgtcatttctcac

SEQ ID NO: 980603 - DNA, 25 bp, Mus musculus
ttttggcatatgaatttctctggct

SEQ ID NO: 980604 - DNA, 25 bp, Mus musculus
ttttggcatatgtatttctctggct

SEQ ID NO: 980605 - DNA, 25 bp, Mus musculus
ttttggcatctcctatcagatcaac

SEQ ID NO: 980606 - DNA, 25 bp, Mus musculus
ttttggcatctcgtatcagatcaac

SEQ ID NO: 980607 - DNA, 25 bp, Mus musculus
ttttggcatcttacttgttggctga

SEQ ID NO: 980608 - DNA, 25 bp, Mus musculus
ttttggcatcttctgcaacagcact

SEQ ID NO: 980609 - DNA, 25 bp, Mus musculus
ttttggcatcttgtgcaacagcact

SEQ ID NO: 980610 - DNA, 25 bp, Mus musculus
ttttggcatctttcttgttggctga

SEQ ID NO: 980611 - DNA, 25 bp, Mus musculus
ttttggcattgactctttccatccc

SEQ ID NO: 980612 - DNA, 25 bp, Mus musculus
ttttggcattgagtctttccatccc

SEQ ID NO: 980613 - DNA, 25 bp, Mus musculus
ttttggccaaagagacttcttatgt

SEQ ID NO: 980614 - DNA, 25 bp, Mus musculus
ttttggccaaagtgacttcttatgt

SEQ ID NO: 980615 - DNA, 25 bp, Mus musculus
ttttggccacagctctttgattttt

SEQ ID NO: 980616 - DNA, 25 bp, Mus musculus
ttttggccacaggtctttgattttt

SEQ ID NO: 980617 - DNA, 25 bp, Mus musculus
ttttggccactccttttgtctctgt

SEQ ID NO: 980618 - DNA, 25 bp, Mus musculus
ttttggccactcgttttgtctctgt

SEQ ID NO: 980619 - DNA, 25 bp, Mus musculus
ttttggccagggacttactctgcac

SEQ ID NO: 980620 - DNA, 25 bp, Mus musculus
ttttggccagggtcttactctgcac

SEQ ID NO: 980621 - DNA, 25 bp, Mus musculus
ttttggccataaacacttagtgtgt

SEQ ID NO: 980622 - DNA, 25 bp, Mus musculus
ttttggccataatcacttagtgtgt

SEQ ID NO: 980623 - DNA, 25 bp, Mus musculus
ttttggccccgtccatcattagtat

SEQ ID NO: 980624 - DNA, 25 bp, Mus musculus
ttttggccccgtgcatcattagtat

SEQ ID NO: 980625 - DNA, 25 bp, Mus musculus
ttttggcccctaacgacctgcaaag

SEQ ID NO: 980626 - DNA, 25 bp, Mus musculus
ttttggcccctatcgacctgcaaag

SEQ ID NO: 980627 - DNA, 25 bp, Mus musculus
ttttggccgcacactacgagaacca

SEQ ID NO: 980628 - DNA, 25 bp, Mus musculus
ttttggccgcactctacgagaacca

SEQ ID NO: 980629 - DNA, 25 bp, Mus musculus
ttttggccgtgtagtcatctaccac

SEQ ID NO: 980630 - DNA, 25 bp, Mus musculus
ttttggccgtgttgtcatctaccac

SEQ ID NO: 980631 - DNA, 25 bp, Mus musculus
ttttggcctccaagaatactttaag

SEQ ID NO: 980632 - DNA, 25 bp, Mus musculus
ttttggcctccacagctactaggta

SEQ ID NO: 980633 - DNA, 25 bp, Mus musculus
ttttggcctccagagctactaggta

SEQ ID NO: 980634 - DNA, 25 bp, Mus musculus
ttttggcctccatgaatactttaag

SEQ ID NO: 980635 - DNA, 25 bp, Mus musculus
ttttggcctgtgagactgactgtgt

SEQ ID NO: 980636 - DNA, 25 bp, Mus musculus
ttttggcctgtgtgactgactgtgt

SEQ ID NO: 980637 - DNA, 25 bp, Mus musculus
ttttggccttctaatcgtggacata

SEQ ID NO: 980638 - DNA, 25 bp, Mus musculus
ttttggccttcttatcgtggacata

SEQ ID NO: 980639 - DNA, 25 bp, Mus musculus
ttttggcgaatacagcgcatgctcg

SEQ ID NO: 980640 - DNA, 25 bp, Mus musculus
ttttggcgaatagagcgcatgctcg

SEQ ID NO: 980641 - DNA, 25 bp, Mus musculus
ttttggcggccaagggcagcaaagt

SEQ ID NO: 980642 - DNA, 25 bp, Mus musculus
ttttggcggccatgggcagcaaagt

SEQ ID NO: 980643 - DNA, 25 bp, Mus musculus
ttttggcggttgacagttttgcact

SEQ ID NO: 980644 - DNA, 25 bp, Mus musculus
ttttggcggttgtcagttttgcact

SEQ ID NO: 980645 - DNA, 25 bp, Mus musculus
ttttggctaggaccataagctgcca

SEQ ID NO: 980646 - DNA, 25 bp, Mus musculus
ttttggctaggagcataagctgcca

SEQ ID NO: 980647 - DNA, 25 bp, Mus musculus
ttttggctccatctacaactaaacc

SEQ ID NO: 980648 - DNA, 25 bp, Mus musculus
ttttggctccatgtacaactaaacc

SEQ ID NO: 980649 - DNA, 25 bp, Mus musculus
ttttggctccttagcaatcatggtg

SEQ ID NO: 980650 - DNA, 25 bp, Mus musculus
ttttggctcctttgcaatcatggtg

SEQ ID NO: 980651 - DNA, 25 bp, Mus musculus
ttttggctcgccaccatagagagaa

SEQ ID NO: 980652 - DNA, 25 bp, Mus musculus
ttttggctcgcctccatagagagaa

SEQ ID NO: 980653 - DNA, 25 bp, Mus musculus
ttttggctctaaagtcagtcccaga

SEQ ID NO: 980654 - DNA, 25 bp, Mus musculus
ttttggctctaatgtcagtcccaga

SEQ ID NO: 980655 - DNA, 25 bp, Mus musculus
ttttggctctctaggaaactgcttc

SEQ ID NO: 980656 - DNA, 25 bp, Mus musculus
ttttggctctcttggaaactgcttc

SEQ ID NO: 980657 - DNA, 25 bp, Mus musculus
ttttggctgccaaatgtggtgctaa

SEQ ID NO: 980658 - DNA, 25 bp, Mus musculus
ttttggctgccatatgtggtgctaa

SEQ ID NO: 980659 - DNA, 25 bp, Mus musculus
ttttggctggaaatgtcaatggtta

SEQ ID NO: 980660 - DNA, 25 bp, Mus musculus
ttttggctggaattgtcaatggtta

SEQ ID NO: 980661 - DNA, 25 bp, Mus musculus
ttttggctggctaaatgtcaacttg

SEQ ID NO: 980662 - DNA, 25 bp, Mus musculus
ttttggctggcttaatgtcaacttg

SEQ ID NO: 980663 - DNA, 25 bp, Mus musculus
ttttggcttaacagtaactgctagt

SEQ ID NO: 980664 - DNA, 25 bp, Mus musculus
ttttggcttaactgtaactgctagt

SEQ ID NO: 980665 - DNA, 25 bp, Mus musculus
ttttggcttgagctctgatttcccc

SEQ ID NO: 980666 - DNA, 25 bp, Mus musculus
ttttggcttgaggtctgatttcccc

SEQ ID NO: 980667 - DNA, 25 bp, Mus musculus
ttttggcttttcagtgtctttacaa

SEQ ID NO: 980668 - DNA, 25 bp, Mus musculus
ttttggcttttctgtgtctttacaa

SEQ ID NO: 980669 - DNA, 25 bp, Mus musculus
ttttgggaaaccagtagcgactgct

SEQ ID NO: 980670 - DNA, 25 bp, Mus musculus
ttttgggaaacctgtagcgactgct

SEQ ID NO: 980671 - DNA, 25 bp, Mus musculus
ttttgggaagcacccgtgtgtctac

SEQ ID NO: 980672 - DNA, 25 bp, Mus musculus
ttttgggaagcagccgtgtgtctac

SEQ ID NO: 980673 - DNA, 25 bp, Mus musculus
ttttgggaagccaggcaaagcccct

SEQ ID NO: 980674 - DNA, 25 bp, Mus musculus
ttttgggaagcctggcaaagcccct

SEQ ID NO: 980675 - DNA, 25 bp, Mus musculus
ttttgggaagttatgtgttcttatg

SEQ ID NO: 980676 - DNA, 25 bp, Mus musculus
ttttgggaagttttgtgttcttatg

SEQ ID NO: 980677 - DNA, 25 bp, Mus musculus
ttttgggacctacacgccagggcca

SEQ ID NO: 980678 - DNA, 25 bp, Mus musculus
ttttgggacctagacgccagggcca

SEQ ID NO: 980679 - DNA, 25 bp, Mus musculus
ttttgggacctgcagaaatcttttt

SEQ ID NO: 980680 - DNA, 25 bp, Mus musculus
ttttgggacctggagaaatcttttt

SEQ ID NO: 980681 - DNA, 25 bp, Mus musculus
ttttgggactgaaagagagacgcca

SEQ ID NO: 980682 - DNA, 25 bp, Mus musculus
ttttgggactgatagagagacgcca

SEQ ID NO: 980683 - DNA, 25 bp, Mus musculus
ttttgggactgcatgctctggtaga

SEQ ID NO: 980684 - DNA, 25 bp, Mus musculus
ttttgggactgcttgctctggtaga

SEQ ID NO: 980685 - DNA, 25 bp, Mus musculus
ttttgggagagtactgcccagctgt

SEQ ID NO: 980686 - DNA, 25 bp, Mus musculus
ttttgggagagttctgcccagctgt

SEQ ID NO: 980687 - DNA, 25 bp, Mus musculus
ttttgggattccaagagtccccaga

SEQ ID NO: 980688 - DNA, 25 bp, Mus musculus
ttttgggattcctagagtccccaga

SEQ ID NO: 980689 - DNA, 25 bp, Mus musculus
ttttgggcaaaaatgagagagccat

SEQ ID NO: 980690 - DNA, 25 bp, Mus musculus
ttttgggcaaaattgagagagccat

SEQ ID NO: 980691 - DNA, 25 bp, Mus musculus
ttttgggcacggctacaggatcact

SEQ ID NO: 980692 - DNA, 25 bp, Mus musculus
ttttgggcacgggtacaggatcact

SEQ ID NO: 980693 - DNA, 25 bp, Mus musculus
ttttgggcagctagcttactgccta

SEQ ID NO: 980694 - DNA, 25 bp, Mus musculus
ttttgggcagcttgcttactgccta

SEQ ID NO: 980695 - DNA, 25 bp, Mus musculus
ttttgggcagtgagtgcgctatcct

SEQ ID NO: 980696 - DNA, 25 bp, Mus musculus
ttttgggcagtgtgtgcgctatcct

SEQ ID NO: 980697 - DNA, 25 bp, Mus musculus
ttttgggccgtacaggattcaccat

SEQ ID NO: 980698 - DNA, 25 bp, Mus musculus
ttttgggccgtagaggattcaccat

SEQ ID NO: 980699 - DNA, 25 bp, Mus musculus
ttttgggcctatctggaatattctc

SEQ ID NO: 980700 - DNA, 25 bp, Mus musculus
ttttgggcctatgtggaatattctc

SEQ ID NO: 980701 - DNA, 25 bp, Mus musculus
ttttgggcctctcggaaggcagcca

SEQ ID NO: 980702 - DNA, 25 bp, Mus musculus
ttttgggcctctgggaaggcagcca

SEQ ID NO: 980703 - DNA, 25 bp, Mus musculus
ttttgggccttcatagggtccattt

SEQ ID NO: 980704 - DNA, 25 bp, Mus musculus
ttttgggccttcttagggtccattt

SEQ ID NO: 980705 - DNA, 25 bp, Mus musculus
ttttggggacacagactcagggact

SEQ ID NO: 980706 - DNA, 25 bp, Mus musculus
ttttggggacactgactcagggact

SEQ ID NO: 980707 - DNA, 25 bp, Mus musculus
ttttggggccttagtcagactgcac

SEQ ID NO: 980708 - DNA, 25 bp, Mus musculus
ttttggggcctttgtcagactgcac

SEQ ID NO: 980709 - DNA, 25 bp, Mus musculus
ttttgggtaccaacaagtcgtgtta

SEQ ID NO: 980710 - DNA, 25 bp, Mus musculus
ttttgggtaccatcaagtcgtgtta

SEQ ID NO: 980711 - DNA, 25 bp, Mus musculus
ttttgggtagtcacatgggtgccat

SEQ ID NO: 980712 - DNA, 25 bp, Mus musculus
ttttgggtagtctcatgggtgccat

SEQ ID NO: 980713 - DNA, 25 bp, Mus musculus
ttttgggtattcatgtggtccattt

SEQ ID NO: 980714 - DNA, 25 bp, Mus musculus
ttttgggtattcttgtggtccattt

SEQ ID NO: 980715 - DNA, 25 bp, Mus musculus
ttttgggtcaagagccattgaagca

SEQ ID NO: 980716 - DNA, 25 bp, Mus musculus
ttttgggtcaagtgccattgaagca

SEQ ID NO: 980717 - DNA, 25 bp, Mus musculus
ttttgggtcacaaaacctgtcataa

SEQ ID NO: 980718 - DNA, 25 bp, Mus musculus
ttttgggtcacataacctgtcataa

SEQ ID NO: 980719 - DNA, 25 bp, Mus musculus
ttttgggtcatgacctgcgggtagc

SEQ ID NO: 980720 - DNA, 25 bp, Mus musculus
ttttgggtcatgtcctgcgggtagc

SEQ ID NO: 980721 - DNA, 25 bp, Mus musculus
ttttgggtcctgagtaacgaagcat

SEQ ID NO: 980722 - DNA, 25 bp, Mus musculus
ttttgggtcctgtgtaacgaagcat

SEQ ID NO: 980723 - DNA, 25 bp, Mus musculus
ttttgggtctctaactcttgcctga

SEQ ID NO: 980724 - DNA, 25 bp, Mus musculus
ttttgggtctcttactcttgcctga

SEQ ID NO: 980725 - DNA, 25 bp, Mus musculus
ttttgggtgacaaggcagccgctat

SEQ ID NO: 980726 - DNA, 25 bp, Mus musculus
ttttgggtgacatggcagccgctat

SEQ ID NO: 980727 - DNA, 25 bp, Mus musculus
ttttgggtgtacaccagaagccctt

SEQ ID NO: 980728 - DNA, 25 bp, Mus musculus
ttttgggtgtactccagaagccctt

SEQ ID NO: 980729 - DNA, 25 bp, Mus musculus
ttttgggtgtatattgctaagtgaa

SEQ ID NO: 980730 - DNA, 25 bp, Mus musculus
ttttgggtgtattttgctaagtgaa

SEQ ID NO: 980731 - DNA, 25 bp, Mus musculus
ttttgggttatgcactctcgggtga

SEQ ID NO: 980732 - DNA, 25 bp, Mus musculus
ttttgggttatggactctcgggtga

SEQ ID NO: 980733 - DNA, 25 bp, Mus musculus
ttttggtaacgcctccaggcccagt

SEQ ID NO: 980734 - DNA, 25 bp, Mus musculus
ttttggtaacgcgtccaggcccagt

SEQ ID NO: 980735 - DNA, 25 bp, Mus musculus
ttttggtaactgctaagttccagat

SEQ ID NO: 980736 - DNA, 25 bp, Mus musculus
ttttggtaactggtaagttccagat

SEQ ID NO: 980737 - DNA, 25 bp, Mus musculus
ttttggtaagtcagtcacagtcatt

SEQ ID NO: 980738 - DNA, 25 bp, Mus musculus
ttttggtaagtctgtcacagtcatt

SEQ ID NO: 980739 - DNA, 25 bp, Mus musculus
ttttggtaatacaactatggcatac

SEQ ID NO: 980740 - DNA, 25 bp, Mus musculus
ttttggtaatactactatggcatac

SEQ ID NO: 980741 - DNA, 25 bp, Mus musculus
ttttggtaatgtatcctcagctccg

SEQ ID NO: 980742 - DNA, 25 bp, Mus musculus
ttttggtaatgtttcctcagctccg

SEQ ID NO: 980743 - DNA, 25 bp, Mus musculus
ttttggtacagactctcagtaccta

SEQ ID NO: 980744 - DNA, 25 bp, Mus musculus
ttttggtacagagtctcagtaccta

SEQ ID NO: 980745 - DNA, 25 bp, Mus musculus
ttttggtacagcctcctgaaggagt

SEQ ID NO: 980746 - DNA, 25 bp, Mus musculus
ttttggtacagcgtcctgaaggagt

SEQ ID NO: 980747 - DNA, 25 bp, Mus musculus
ttttggtacaggaaactggacccag

SEQ ID NO: 980748 - DNA, 25 bp, Mus musculus
ttttggtacaggtaactggacccag

SEQ ID NO: 980749 - DNA, 25 bp, Mus musculus
ttttggtactttcctggccacacaa

SEQ ID NO: 980750 - DNA, 25 bp, Mus musculus
ttttggtactttgctggccacacaa

SEQ ID NO: 980751 - DNA, 25 bp, Mus musculus
ttttggtatgaaccgactctgcctg

SEQ ID NO: 980752 - DNA, 25 bp, Mus musculus
ttttggtatgaagcgactctgcctg

SEQ ID NO: 980753 - DNA, 25 bp, Mus musculus
ttttggtcaccaacactattactgt

SEQ ID NO: 980754 - DNA, 25 bp, Mus musculus
ttttggtcaccatcactattactgt

SEQ ID NO: 980755 - DNA, 25 bp, Mus musculus
ttttggtcattcaatcagcttgctg

SEQ ID NO: 980756 - DNA, 25 bp, Mus musculus
ttttggtcattctatcagcttgctg

SEQ ID NO: 980757 - DNA, 25 bp, Mus musculus
ttttggtcatttactgcacgcaccc

SEQ ID NO: 980758 - DNA, 25 bp, Mus musculus
ttttggtcattttctgcacgcaccc

SEQ ID NO: 980759 - DNA, 25 bp, Mus musculus
ttttggtccctgctgagttttgtac

SEQ ID NO: 980760 - DNA, 25 bp, Mus musculus
ttttggtccctggtgagttttgtac

SEQ ID NO: 980761 - DNA, 25 bp, Mus musculus
ttttggtcctgtattgtgcccataa

SEQ ID NO: 980762 - DNA, 25 bp, Mus musculus
ttttggtcctgttttgtgcccataa

SEQ ID NO: 980763 - DNA, 25 bp, Mus musculus
ttttggtcgaggagggaacttcagt

SEQ ID NO: 980764 - DNA, 25 bp, Mus musculus
ttttggtcgaggtgggaacttcagt

SEQ ID NO: 980765 - DNA, 25 bp, Mus musculus
ttttggtctcttcaagcctgcctgt

SEQ ID NO: 980766 - DNA, 25 bp, Mus musculus
ttttggtctcttgaagcctgcctgt

SEQ ID NO: 980767 - DNA, 25 bp, Mus musculus
ttttggtctgtgaaccctctgagct

SEQ ID NO: 980768 - DNA, 25 bp, Mus musculus
ttttggtctgtgtaccctctgagct

SEQ ID NO: 980769 - DNA, 25 bp, Mus musculus
ttttggtgaattaccactcagtcgg

SEQ ID NO: 980770 - DNA, 25 bp, Mus musculus
ttttggtgaatttccactcagtcgg

SEQ ID NO: 980771 - DNA, 25 bp, Mus musculus
ttttggtgccaactgcttgaaggag

SEQ ID NO: 980772 - DNA, 25 bp, Mus musculus
ttttggtgccaagtgcttgaaggag

SEQ ID NO: 980773 - DNA, 25 bp, Mus musculus
ttttggtgcctcagtctaggaagct

SEQ ID NO: 980774 - DNA, 25 bp, Mus musculus
ttttggtgcctctgtctaggaagct

SEQ ID NO: 980775 - DNA, 25 bp, Mus musculus
ttttggtgccttacctcttacagag

SEQ ID NO: 980776 - DNA, 25 bp, Mus musculus
ttttggtgcctttcctcttacagag

SEQ ID NO: 980777 - DNA, 25 bp, Mus musculus
ttttggtggaaaacgtagcctctga

SEQ ID NO: 980778 - DNA, 25 bp, Mus musculus
ttttggtggaaatcgtagcctctga

SEQ ID NO: 980779 - DNA, 25 bp, Mus musculus
ttttggtggaacaagcagccgccct

SEQ ID NO: 980780 - DNA, 25 bp, Mus musculus
ttttggtggaactagcagccgccct

SEQ ID NO: 980781 - DNA, 25 bp, Mus musculus
ttttggtggaagaagctcaggcagt

SEQ ID NO: 980782 - DNA, 25 bp, Mus musculus
ttttggtggaagtagctcaggcagt

SEQ ID NO: 980783 - DNA, 25 bp, Mus musculus
ttttggtggctaatattgcccctgc

SEQ ID NO: 980784 - DNA, 25 bp, Mus musculus
ttttggtggctattattgcccctgc

SEQ ID NO: 980785 - DNA, 25 bp, Mus musculus
ttttggtggtctcggccctgctact

SEQ ID NO: 980786 - DNA, 25 bp, Mus musculus
ttttggtggtctgggccctgctact

SEQ ID NO: 980787 - DNA, 25 bp, Mus musculus
ttttggtggtgtatagtcttatgaa

SEQ ID NO: 980788 - DNA, 25 bp, Mus musculus
ttttggtggtgtttagtcttatgaa

SEQ ID NO: 980789 - DNA, 25 bp, Mus musculus
ttttggtgtgacagatgtgcccagt

SEQ ID NO: 980790 - DNA, 25 bp, Mus musculus
ttttggtgtgactgatgtgcccagt

SEQ ID NO: 980791 - DNA, 25 bp, Mus musculus
ttttggtgttccatcatgctgtctt

SEQ ID NO: 980792 - DNA, 25 bp, Mus musculus
ttttggtgttccttcatgctgtctt

SEQ ID NO: 980793 - DNA, 25 bp, Mus musculus
ttttggtgttctaggagacagagca

SEQ ID NO: 980794 - DNA, 25 bp, Mus musculus
ttttggtgttcttggagacagagca

SEQ ID NO: 980795 - DNA, 25 bp, Mus musculus
ttttggttacatcgcatctggcagg

SEQ ID NO: 980796 - DNA, 25 bp, Mus musculus
ttttggttacatggcatctggcagg

SEQ ID NO: 980797 - DNA, 25 bp, Mus musculus
ttttggttagctacgtcactcactg

SEQ ID NO: 980798 - DNA, 25 bp, Mus musculus
ttttggttagcttcgtcactcactg

SEQ ID NO: 980799 - DNA, 25 bp, Mus musculus
ttttggttcactaccatcctgagac

SEQ ID NO: 980800 - DNA, 25 bp, Mus musculus
ttttggttcacttccatcctgagac

SEQ ID NO: 980801 - DNA, 25 bp, Mus musculus
ttttggttccatagaatatcctgta

SEQ ID NO: 980802 - DNA, 25 bp, Mus musculus
ttttggttccattgaatatcctgta

SEQ ID NO: 980803 - DNA, 25 bp, Mus musculus
ttttggttcctaccaaccacctcag

SEQ ID NO: 980804 - DNA, 25 bp, Mus musculus
ttttggttcctagcaaccacctcag

SEQ ID NO: 980805 - DNA, 25 bp, Mus musculus
ttttggttcctgagaaggacaccta

SEQ ID NO: 980806 - DNA, 25 bp, Mus musculus
ttttggttcctgtgaaggacaccta

SEQ ID NO: 980807 - DNA, 25 bp, Mus musculus
ttttggttccttcatctggtcttta

SEQ ID NO: 980808 - DNA, 25 bp, Mus musculus
ttttggttccttgatctggtcttta

SEQ ID NO: 980809 - DNA, 25 bp, Mus musculus
ttttggttggaaccctccagagtgc

SEQ ID NO: 980810 - DNA, 25 bp, Mus musculus
ttttggttggaagcctccagagtgc

SEQ ID NO: 980811 - DNA, 25 bp, Mus musculus
ttttggtttactccacatgaagcaa

SEQ ID NO: 980812 - DNA, 25 bp, Mus musculus
ttttggtttactgcacatgaagcaa

SEQ ID NO: 980813 - DNA, 25 bp, Mus musculus
ttttggtttcttattcaaagatgat

SEQ ID NO: 980814 - DNA, 25 bp, Mus musculus
ttttggtttctttttcaaagatgat

SEQ ID NO: 980815 - DNA, 25 bp, Mus musculus
ttttggttttgcacccttgtagacg

SEQ ID NO: 980816 - DNA, 25 bp, Mus musculus
ttttggttttgctcccttgtagacg

SEQ ID NO: 980817 - DNA, 25 bp, Mus musculus
ttttggtttttcaccagagcaaaga

SEQ ID NO: 980818 - DNA, 25 bp, Mus musculus
ttttggtttttctccagagcaaaga

SEQ ID NO: 980819 - DNA, 25 bp, Mus musculus
ttttgtaaacatctctaacccctgc

SEQ ID NO: 980820 - DNA, 25 bp, Mus musculus
ttttgtaaacatgtctaacccctgc

SEQ ID NO: 980821 - DNA, 25 bp, Mus musculus
ttttgtaaacctcggcccttgcaag

SEQ ID NO: 980822 - DNA, 25 bp, Mus musculus
ttttgtaaacctgggcccttgcaag

SEQ ID NO: 980823 - DNA, 25 bp, Mus musculus
ttttgtaaagtgaggcgggctagac

SEQ ID NO: 980824 - DNA, 25 bp, Mus musculus
ttttgtaaagtgtggcgggctagac

SEQ ID NO: 980825 - DNA, 25 bp, Mus musculus
ttttgtaaatgtaatgcactctgaa

SEQ ID NO: 980826 - DNA, 25 bp, Mus musculus
ttttgtaaatgttatgcactctgaa

SEQ ID NO: 980827 - DNA, 25 bp, Mus musculus
ttttgtaacagtaaccaggctcgca

SEQ ID NO: 980828 - DNA, 25 bp, Mus musculus
ttttgtaacagttaccaggctcgca

SEQ ID NO: 980829 - DNA, 25 bp, Mus musculus
ttttgtaaccagcaccaaatcaaga

SEQ ID NO: 980830 - DNA, 25 bp, Mus musculus
ttttgtaaccaggaccaaatcaaga

SEQ ID NO: 980831 - DNA, 25 bp, Mus musculus
ttttgtaacccacagtgagaaagct

SEQ ID NO: 980832 - DNA, 25 bp, Mus musculus
ttttgtaacccagagtgagaaagct

SEQ ID NO: 980833 - DNA, 25 bp, Mus musculus
ttttgtaacctcattctgaccttgt

SEQ ID NO: 980834 - DNA, 25 bp, Mus musculus
ttttgtaacctctttctgaccttgt

SEQ ID NO: 980835 - DNA, 25 bp, Mus musculus
ttttgtaaccttctaaccacctgct

SEQ ID NO: 980836 - DNA, 25 bp, Mus musculus
ttttgtaaccttgtaaccacctgct

SEQ ID NO: 980837 - DNA, 25 bp, Mus musculus
ttttgtaagacgaccctgcagtcca

SEQ ID NO: 980838 - DNA, 25 bp, Mus musculus
ttttgtaagacgtccctgcagtcca

SEQ ID NO: 980839 - DNA, 25 bp, Mus musculus
ttttgtaataaaaggacttgaagct

SEQ ID NO: 980840 - DNA, 25 bp, Mus musculus
ttttgtaataaatggacttgaagct

SEQ ID NO: 980841 - DNA, 25 bp, Mus musculus
ttttgtaatacaaatgcttacccta

SEQ ID NO: 980842 - DNA, 25 bp, Mus musculus
ttttgtaatacatatgcttacccta

SEQ ID NO: 980843 - DNA, 25 bp, Mus musculus
ttttgtaatgaacgcatggacttga

SEQ ID NO: 980844 - DNA, 25 bp, Mus musculus
ttttgtaatgaaggcatggacttga

SEQ ID NO: 980845 - DNA, 25 bp, Mus musculus
ttttgtaatgctagcccccaagatg

SEQ ID NO: 980846 - DNA, 25 bp, Mus musculus
ttttgtaatgcttgcccccaagatg

SEQ ID NO: 980847 - DNA, 25 bp, Mus musculus
ttttgtaatgtaccccagatttctc

SEQ ID NO: 980848 - DNA, 25 bp, Mus musculus
ttttgtaatgtagcccagatttctc

SEQ ID NO: 980849 - DNA, 25 bp, Mus musculus
ttttgtacactaatgcctgcacttg

SEQ ID NO: 980850 - DNA, 25 bp, Mus musculus
ttttgtacactattgcctgcacttg

SEQ ID NO: 980851 - DNA, 25 bp, Mus musculus
ttttgtacattgaccttgttcgcga

SEQ ID NO: 980852 - DNA, 25 bp, Mus musculus
ttttgtacattgtccttgttcgcga

SEQ ID NO: 980853 - DNA, 25 bp, Mus musculus
ttttgtacctttattctcacctgct

SEQ ID NO: 980854 - DNA, 25 bp, Mus musculus
ttttgtaccttttttctcacctgct

SEQ ID NO: 980855 - DNA, 25 bp, Mus musculus
ttttgtactcttatcatgctttatg

SEQ ID NO: 980856 - DNA, 25 bp, Mus musculus
ttttgtactcttttcatgctttatg

SEQ ID NO: 980857 - DNA, 25 bp, Mus musculus
ttttgtactgaccaatgcaaggctc

SEQ ID NO: 980858 - DNA, 25 bp, Mus musculus
ttttgtactgacgaatgcaaggctc

SEQ ID NO: 980859 - DNA, 25 bp, Mus musculus
ttttgtacttacaattctctccagc

SEQ ID NO: 980860 - DNA, 25 bp, Mus musculus
ttttgtacttactattctctccagc

SEQ ID NO: 980861 - DNA, 25 bp, Mus musculus
ttttgtacttgacatgattccggaa

SEQ ID NO: 980862 - DNA, 25 bp, Mus musculus
ttttgtacttgagatgattccggaa

SEQ ID NO: 980863 - DNA, 25 bp, Mus musculus
ttttgtaggactacatatccagcct

SEQ ID NO: 980864 - DNA, 25 bp, Mus musculus
ttttgtaggacttcatatccagcct

SEQ ID NO: 980865 - DNA, 25 bp, Mus musculus
ttttgtagggatcacgttttcttat

SEQ ID NO: 980866 - DNA, 25 bp, Mus musculus
ttttgtagggatgacgttttcttat

SEQ ID NO: 980867 - DNA, 25 bp, Mus musculus
ttttgtagtaacagtccatcgtgga

SEQ ID NO: 980868 - DNA, 25 bp, Mus musculus
ttttgtagtaactgtccatcgtgga

SEQ ID NO: 980869 - DNA, 25 bp, Mus musculus
ttttgtagttggacagacagggctt

SEQ ID NO: 980870 - DNA, 25 bp, Mus musculus
ttttgtagttggtcagacagggctt

SEQ ID NO: 980871 - DNA, 25 bp, Mus musculus
ttttgtatactaaatcacttagaca

SEQ ID NO: 980872 - DNA, 25 bp, Mus musculus
ttttgtatactatatcacttagaca

SEQ ID NO: 980873 - DNA, 25 bp, Mus musculus
ttttgtataggaccccaggcagggc

SEQ ID NO: 980874 - DNA, 25 bp, Mus musculus
ttttgtataggagcccaggcagggc

SEQ ID NO: 980875 - DNA, 25 bp, Mus musculus
ttttgtatatttaccaactatgggc

SEQ ID NO: 980876 - DNA, 25 bp, Mus musculus
ttttgtatattttccaactatgggc

SEQ ID NO: 980877 - DNA, 25 bp, Mus musculus
ttttgtatcaaaagggtgccagaga

SEQ ID NO: 980878 - DNA, 25 bp, Mus musculus
ttttgtatcaaatgggtgccagaga

SEQ ID NO: 980879 - DNA, 25 bp, Mus musculus
ttttgtatccccatgtttgttatag

SEQ ID NO: 980880 - DNA, 25 bp, Mus musculus
ttttgtatccccttgtttgttatag

SEQ ID NO: 980881 - DNA, 25 bp, Mus musculus
ttttgtatctgtaacccttgttgaa

SEQ ID NO: 980882 - DNA, 25 bp, Mus musculus
ttttgtatctgttacccttgttgaa

SEQ ID NO: 980883 - DNA, 25 bp, Mus musculus
ttttgtatctttatgctcccctaat

SEQ ID NO: 980884 - DNA, 25 bp, Mus musculus
ttttgtatctttttgctcccctaat

SEQ ID NO: 980885 - DNA, 25 bp, Mus musculus
ttttgtatgactattgctagctata

SEQ ID NO: 980886 - DNA, 25 bp, Mus musculus
ttttgtatgacttttgctagctata

SEQ ID NO: 980887 - DNA, 25 bp, Mus musculus
ttttgtatgcatactttattcactt

SEQ ID NO: 980888 - DNA, 25 bp, Mus musculus
ttttgtatgcattctttattcactt

SEQ ID NO: 980889 - DNA, 25 bp, Mus musculus
ttttgtatgctcagttttgtgactt

SEQ ID NO: 980890 - DNA, 25 bp, Mus musculus
ttttgtatgctctgttttgtgactt

SEQ ID NO: 980891 - DNA, 25 bp, Mus musculus
ttttgtatgtgtcgagactctggac

SEQ ID NO: 980892 - DNA, 25 bp, Mus musculus
ttttgtatgtgtggagactctggac

SEQ ID NO: 980893 - DNA, 25 bp, Mus musculus
ttttgtatgtttcttatctgtgtat

SEQ ID NO: 980894 - DNA, 25 bp, Mus musculus
ttttgtatgtttgttatctgtgtat

SEQ ID NO: 980895 - DNA, 25 bp, Mus musculus
ttttgtattacaatgctaaccgggc

SEQ ID NO: 980896 - DNA, 25 bp, Mus musculus
ttttgtattacattgctaaccgggc

SEQ ID NO: 980897 - DNA, 25 bp, Mus musculus
ttttgtattcgcattcctggaggtg

SEQ ID NO: 980898 - DNA, 25 bp, Mus musculus
ttttgtattcgctttcctggaggtg

SEQ ID NO: 980899 - DNA, 25 bp, Mus musculus
ttttgtattgatagcctggtttgtt

SEQ ID NO: 980900 - DNA, 25 bp, Mus musculus
ttttgtattgattgcctggtttgtt

SEQ ID NO: 980901 - DNA, 25 bp, Mus musculus
ttttgtattgtgattccaggcctct

SEQ ID NO: 980902 - DNA, 25 bp, Mus musculus
ttttgtattgtgtttccaggcctct

SEQ ID NO: 980903 - DNA, 25 bp, Mus musculus
ttttgtatttctactgtgcctgagt

SEQ ID NO: 980904 - DNA, 25 bp, Mus musculus
ttttgtatttcttctgtgcctgagt

SEQ ID NO: 980905 - DNA, 25 bp, Mus musculus
ttttgtcacaccattgtgtggccac

SEQ ID NO: 980906 - DNA, 25 bp, Mus musculus
ttttgtcacacctttgtgtggccac

SEQ ID NO: 980907 - DNA, 25 bp, Mus musculus
ttttgtcacatgatccttattccca

SEQ ID NO: 980908 - DNA, 25 bp, Mus musculus
ttttgtcacatgttccttattccca

SEQ ID NO: 980909 - DNA, 25 bp, Mus musculus
ttttgtcaccccaggcttactttga

SEQ ID NO: 980910 - DNA, 25 bp, Mus musculus
ttttgtcacccctggcttactttga

SEQ ID NO: 980911 - DNA, 25 bp, Mus musculus
ttttgtcacctcatgtaccttccag

SEQ ID NO: 980912 - DNA, 25 bp, Mus musculus
ttttgtcacctcttgtaccttccag

SEQ ID NO: 980913 - DNA, 25 bp, Mus musculus
ttttgtcacgttatagtcgaggcat

SEQ ID NO: 980914 - DNA, 25 bp, Mus musculus
ttttgtcacgttttagtcgaggcat

SEQ ID NO: 980915 - DNA, 25 bp, Mus musculus
ttttgtcagaacattcaacttcaca

SEQ ID NO: 980916 - DNA, 25 bp, Mus musculus
ttttgtcagaactttcaacttcaca

SEQ ID NO: 980917 - DNA, 25 bp, Mus musculus
ttttgtcagacccaatggcatttga

SEQ ID NO: 980918 - DNA, 25 bp, Mus musculus
ttttgtcagaccgaatggcatttga

SEQ ID NO: 980919 - DNA, 25 bp, Mus musculus
ttttgtcagagaacgcaggtcacct

SEQ ID NO: 980920 - DNA, 25 bp, Mus musculus
ttttgtcagagatcgcaggtcacct

SEQ ID NO: 980921 - DNA, 25 bp, Mus musculus
ttttgtcagtctaagtgcctggctt

SEQ ID NO: 980922 - DNA, 25 bp, Mus musculus
ttttgtcagtcttagtgcctggctt

SEQ ID NO: 980923 - DNA, 25 bp, Mus musculus
ttttgtcagtgacgtttctgtgtgg

SEQ ID NO: 980924 - DNA, 25 bp, Mus musculus
ttttgtcagtgaggtttctgtgtgg

SEQ ID NO: 980925 - DNA, 25 bp, Mus musculus
ttttgtcatattagttcctgccttc

SEQ ID NO: 980926 - DNA, 25 bp, Mus musculus
ttttgtcatatttgttcctgccttc

SEQ ID NO: 980927 - DNA, 25 bp, Mus musculus
ttttgtcatcgcactatggaacaca

SEQ ID NO: 980928 - DNA, 25 bp, Mus musculus
ttttgtcatcgctctatggaacaca

SEQ ID NO: 980929 - DNA, 25 bp, Mus musculus
ttttgtcatggaatcaggcggcccc

SEQ ID NO: 980930 - DNA, 25 bp, Mus musculus
ttttgtcatggattcaggcggcccc

SEQ ID NO: 980931 - DNA, 25 bp, Mus musculus
ttttgtccaacgaggtaaggctgaa

SEQ ID NO: 980932 - DNA, 25 bp, Mus musculus
ttttgtccaacgtggtaaggctgaa

SEQ ID NO: 980933 - DNA, 25 bp, Mus musculus
ttttgtccaccaagcatacactagg

SEQ ID NO: 980934 - DNA, 25 bp, Mus musculus
ttttgtccaccatgcatacactagg

SEQ ID NO: 980935 - DNA, 25 bp, Mus musculus
ttttgtccactgactttccactagt

SEQ ID NO: 980936 - DNA, 25 bp, Mus musculus
ttttgtccactgtctttccactagt

SEQ ID NO: 980937 - DNA, 25 bp, Mus musculus
ttttgtccaggcacctttaatccta

SEQ ID NO: 980938 - DNA, 25 bp, Mus musculus
ttttgtccaggctcctttaatccta

SEQ ID NO: 980939 - DNA, 25 bp, Mus musculus
ttttgtcccattacttccatcttct

SEQ ID NO: 980940 - DNA, 25 bp, Mus musculus
ttttgtcccatttcttccatcttct

SEQ ID NO: 980941 - DNA, 25 bp, Mus musculus
ttttgtccccgtcctttaggatatt

SEQ ID NO: 980942 - DNA, 25 bp, Mus musculus
ttttgtccccgtgctttaggatatt

SEQ ID NO: 980943 - DNA, 25 bp, Mus musculus
ttttgtccctggctgcttattacag

SEQ ID NO: 980944 - DNA, 25 bp, Mus musculus
ttttgtccctgggtgcttattacag

SEQ ID NO: 980945 - DNA, 25 bp, Mus musculus
ttttgtccctttctctacatcttag

SEQ ID NO: 980946 - DNA, 25 bp, Mus musculus
ttttgtccctttgtctacatcttag

SEQ ID NO: 980947 - DNA, 25 bp, Mus musculus
ttttgtccgaggaccccttggctat

SEQ ID NO: 980948 - DNA, 25 bp, Mus musculus
ttttgtccgaggtccccttggctat

SEQ ID NO: 980949 - DNA, 25 bp, Mus musculus
ttttgtcctaagcaggacccacaat

SEQ ID NO: 980950 - DNA, 25 bp, Mus musculus
ttttgtcctaaggaggacccacaat

SEQ ID NO: 980951 - DNA, 25 bp, Mus musculus
ttttgtcctaccacctgagtatatg

SEQ ID NO: 980952 - DNA, 25 bp, Mus musculus
ttttgtcctacctcctgagtatatg

SEQ ID NO: 980953 - DNA, 25 bp, Mus musculus
ttttgtcctggtatcctgtataaag

SEQ ID NO: 980954 - DNA, 25 bp, Mus musculus
ttttgtcctggtctttccagcacca

SEQ ID NO: 980955 - DNA, 25 bp, Mus musculus
ttttgtcctggtgtttccagcacca

SEQ ID NO: 980956 - DNA, 25 bp, Mus musculus
ttttgtcctggtttcctgtataaag

SEQ ID NO: 980957 - DNA, 25 bp, Mus musculus
ttttgtcctgtaactgtagatctgt

SEQ ID NO: 980958 - DNA, 25 bp, Mus musculus
ttttgtcctgtatctgtagatctgt

SEQ ID NO: 980959 - DNA, 25 bp, Mus musculus
ttttgtcctgttatcaccagactga

SEQ ID NO: 980960 - DNA, 25 bp, Mus musculus
ttttgtcctgttttcaccagactga

SEQ ID NO: 980961 - DNA, 25 bp, Mus musculus
ttttgtccttgcacccaatgaaatg

SEQ ID NO: 980962 - DNA, 25 bp, Mus musculus
ttttgtccttgctcccaatgaaatg

SEQ ID NO: 980963 - DNA, 25 bp, Mus musculus
ttttgtcgagctagtgcttcacgat

SEQ ID NO: 980964 - DNA, 25 bp, Mus musculus
ttttgtcgagcttgtgcttcacgat

SEQ ID NO: 980965 - DNA, 25 bp, Mus musculus
ttttgtcgcctaagacccctcctgt

SEQ ID NO: 980966 - DNA, 25 bp, Mus musculus
ttttgtcgcctatgacccctcctgt

SEQ ID NO: 980967 - DNA, 25 bp, Mus musculus
ttttgtctaggcactccactgagct

SEQ ID NO: 980968 - DNA, 25 bp, Mus musculus
ttttgtctaggctctccactgagct

SEQ ID NO: 980969 - DNA, 25 bp, Mus musculus
ttttgtctcacccttttccttgtct

SEQ ID NO: 980970 - DNA, 25 bp, Mus musculus
ttttgtctcaccgttttccttgtct

SEQ ID NO: 980971 - DNA, 25 bp, Mus musculus
ttttgtctcagcactaagaacaact

SEQ ID NO: 980972 - DNA, 25 bp, Mus musculus
ttttgtctcagctctaagaacaact

SEQ ID NO: 980973 - DNA, 25 bp, Mus musculus
ttttgtctccatccctgagaagttt

SEQ ID NO: 980974 - DNA, 25 bp, Mus musculus
ttttgtctccatgcctgagaagttt

SEQ ID NO: 980975 - DNA, 25 bp, Mus musculus
ttttgtctcctaatgccagaagcta

SEQ ID NO: 980976 - DNA, 25 bp, Mus musculus
ttttgtctcctattgccagaagcta

SEQ ID NO: 980977 - DNA, 25 bp, Mus musculus
ttttgtctcctgcttctaggaaagg

SEQ ID NO: 980978 - DNA, 25 bp, Mus musculus
ttttgtctcctggttctaggaaagg

SEQ ID NO: 980979 - DNA, 25 bp, Mus musculus
ttttgtctctacctttccagaagta

SEQ ID NO: 980980 - DNA, 25 bp, Mus musculus
ttttgtctctacgtttccagaagta

SEQ ID NO: 980981 - DNA, 25 bp, Mus musculus
ttttgtctctcaccgtatggtatga

SEQ ID NO: 980982 - DNA, 25 bp, Mus musculus
ttttgtctctcagcgtatggtatga

SEQ ID NO: 980983 - DNA, 25 bp, Mus musculus
ttttgtctcttcaaattgagaccct

SEQ ID NO: 980984 - DNA, 25 bp, Mus musculus
ttttgtctcttcatgtcatccctga

SEQ ID NO: 980985 - DNA, 25 bp, Mus musculus
ttttgtctcttcattctccaggtct

SEQ ID NO: 980986 - DNA, 25 bp, Mus musculus
ttttgtctcttctaattgagaccct

SEQ ID NO: 980987 - DNA, 25 bp, Mus musculus
ttttgtctcttcttgtcatccctga

SEQ ID NO: 980988 - DNA, 25 bp, Mus musculus
ttttgtctcttctttctccaggtct

SEQ ID NO: 980989 - DNA, 25 bp, Mus musculus
ttttgtctctttccgtttaacagga

SEQ ID NO: 980990 - DNA, 25 bp, Mus musculus
ttttgtctctttgcgtttaacagga

SEQ ID NO: 980991 - DNA, 25 bp, Mus musculus
ttttgtctgatgaagccttggcact

SEQ ID NO: 980992 - DNA, 25 bp, Mus musculus
ttttgtctgatgtagccttggcact

SEQ ID NO: 980993 - DNA, 25 bp, Mus musculus
ttttgtctgcaaactgttacctgat

SEQ ID NO: 980994 - DNA, 25 bp, Mus musculus
ttttgtctgcaatctgttacctgat

SEQ ID NO: 980995 - DNA, 25 bp, Mus musculus
ttttgtctgcttaaaccattgttcg

SEQ ID NO: 980996 - DNA, 25 bp, Mus musculus
ttttgtctgctttaaccattgttcg

SEQ ID NO: 980997 - DNA, 25 bp, Mus musculus
ttttgtctggctcttttgccaaagt

SEQ ID NO: 980998 - DNA, 25 bp, Mus musculus
ttttgtctggctgttttgccaaagt

SEQ ID NO: 980999 - DNA, 25 bp, Mus musculus
ttttgtctgggaacgtgggtctcaa

SEQ ID NO: 981000 - DNA, 25 bp, Mus musculus
ttttgtctgggatcgtgggtctcaa

SEQ ID NO: 981001 - DNA, 25 bp, Mus musculus
ttttgtctgttaactcatcacctgg

SEQ ID NO: 981002 - DNA, 25 bp, Mus musculus
ttttgtctgttatctcatcacctgg

SEQ ID NO: 981003 - DNA, 25 bp, Mus musculus
ttttgtcttcctactgtggaatcct

SEQ ID NO: 981004 - DNA, 25 bp, Mus musculus
ttttgtcttccttctgtggaatcct

SEQ ID NO: 981005 - DNA, 25 bp, Mus musculus
ttttgtcttctcaatactaattggt

SEQ ID NO: 981006 - DNA, 25 bp, Mus musculus
ttttgtcttctctatactaattggt

SEQ ID NO: 981007 - DNA, 25 bp, Mus musculus
ttttgtcttgctctttctaaatttc

SEQ ID NO: 981008 - DNA, 25 bp, Mus musculus
ttttgtcttgctgtttctaaatttc

SEQ ID NO: 981009 - DNA, 25 bp, Mus musculus
ttttgtctttgcctccttcttctgg

SEQ ID NO: 981010 - DNA, 25 bp, Mus musculus
ttttgtctttgcgtccttcttctgg

SEQ ID NO: 981011 - DNA, 25 bp, Mus musculus
ttttgtcttttgatttggcaagagt

SEQ ID NO: 981012 - DNA, 25 bp, Mus musculus
ttttgtcttttgttttggcaagagt

SEQ ID NO: 981013 - DNA, 25 bp, Mus musculus
ttttgtgaagcgaaccatggatatt

SEQ ID NO: 981014 - DNA, 25 bp, Mus musculus
ttttgtgaagcgtaccatggatatt

SEQ ID NO: 981015 - DNA, 25 bp, Mus musculus
ttttgtgaagggatctagctgtgcc

SEQ ID NO: 981016 - DNA, 25 bp, Mus musculus
ttttgtgaagggttctagctgtgcc

SEQ ID NO: 981017 - DNA, 25 bp, Mus musculus
ttttgtgacaggctcccacttgact

SEQ ID NO: 981018 - DNA, 25 bp, Mus musculus
ttttgtgacagggtcccacttgact

SEQ ID NO: 981019 - DNA, 25 bp, Mus musculus
ttttgtgaccccacagacatgttac

SEQ ID NO: 981020 - DNA, 25 bp, Mus musculus
ttttgtgacccctcagacatgttac

SEQ ID NO: 981021 - DNA, 25 bp, Mus musculus
ttttgtgacgtcactttgttaacct

SEQ ID NO: 981022 - DNA, 25 bp, Mus musculus
ttttgtgacgtctctttgttaacct

SEQ ID NO: 981023 - DNA, 25 bp, Mus musculus
ttttgtgactccctaggtgacctga

SEQ ID NO: 981024 - DNA, 25 bp, Mus musculus
ttttgtgactccgtaggtgacctga

SEQ ID NO: 981025 - DNA, 25 bp, Mus musculus
ttttgtgagattacagggtctgtcc

SEQ ID NO: 981026 - DNA, 25 bp, Mus musculus
ttttgtgagatttcagggtctgtcc

SEQ ID NO: 981027 - DNA, 25 bp, Mus musculus
ttttgtgagccactcatccttaccg

SEQ ID NO: 981028 - DNA, 25 bp, Mus musculus
ttttgtgagccagtcatccttaccg

SEQ ID NO: 981029 - DNA, 25 bp, Mus musculus
ttttgtgagccgcttgccctggaaa

SEQ ID NO: 981030 - DNA, 25 bp, Mus musculus
ttttgtgagccggttgccctggaaa

SEQ ID NO: 981031 - DNA, 25 bp, Mus musculus
ttttgtgagcctcaagtctcattga

SEQ ID NO: 981032 - DNA, 25 bp, Mus musculus
ttttgtgagcctgaagtctcattga

SEQ ID NO: 981033 - DNA, 25 bp, Mus musculus
ttttgtgagcttagtggctaacgaa

SEQ ID NO: 981034 - DNA, 25 bp, Mus musculus
ttttgtgagctttgtggctaacgaa

SEQ ID NO: 981035 - DNA, 25 bp, Mus musculus
ttttgtgaggtgagcgccttgtaca

SEQ ID NO: 981036 - DNA, 25 bp, Mus musculus
ttttgtgaggtgtgcgccttgtaca

SEQ ID NO: 981037 - DNA, 25 bp, Mus musculus
ttttgtgagtgcacgcaggcttgat

SEQ ID NO: 981038 - DNA, 25 bp, Mus musculus
ttttgtgagtgctcgcaggcttgat

SEQ ID NO: 981039 - DNA, 25 bp, Mus musculus
ttttgtgagtggcattctcctttaa

SEQ ID NO: 981040 - DNA, 25 bp, Mus musculus
ttttgtgagtgggattctcctttaa

SEQ ID NO: 981041 - DNA, 25 bp, Mus musculus
ttttgtgagtttcctgcccttgctg

SEQ ID NO: 981042 - DNA, 25 bp, Mus musculus
ttttgtgagtttgctgcccttgctg

SEQ ID NO: 981043 - DNA, 25 bp, Mus musculus
ttttgtgatatgagaagctgcttct

SEQ ID NO: 981044 - DNA, 25 bp, Mus musculus
ttttgtgatatgtgaagctgcttct

SEQ ID NO: 981045 - DNA, 25 bp, Mus musculus
ttttgtgatgtccatttcaagggtc

SEQ ID NO: 981046 - DNA, 25 bp, Mus musculus
ttttgtgatgtcgatttcaagggtc

SEQ ID NO: 981047 - DNA, 25 bp, Mus musculus
ttttgtgattaacgctccccttcta

SEQ ID NO: 981048 - DNA, 25 bp, Mus musculus
ttttgtgattaaggctccccttcta

SEQ ID NO: 981049 - DNA, 25 bp, Mus musculus
ttttgtgcaaacaatgctagccttc

SEQ ID NO: 981050 - DNA, 25 bp, Mus musculus
ttttgtgcaaactatgctagccttc

SEQ ID NO: 981051 - DNA, 25 bp, Mus musculus
ttttgtgcacagcaaccatgatatt

SEQ ID NO: 981052 - DNA, 25 bp, Mus musculus
ttttgtgcacaggaaccatgatatt

SEQ ID NO: 981053 - DNA, 25 bp, Mus musculus
ttttgtgcacctaacactgcatgac

SEQ ID NO: 981054 - DNA, 25 bp, Mus musculus
ttttgtgcaccttacactgcatgac

SEQ ID NO: 981055 - DNA, 25 bp, Mus musculus
ttttgtgcaggcctcccgtggtgtt

SEQ ID NO: 981056 - DNA, 25 bp, Mus musculus
ttttgtgcaggcgtcccgtggtgtt

SEQ ID NO: 981057 - DNA, 25 bp, Mus musculus
ttttgtgcagtacatcagcccactc

SEQ ID NO: 981058 - DNA, 25 bp, Mus musculus
ttttgtgcagtagatcagcccactc

SEQ ID NO: 981059 - DNA, 25 bp, Mus musculus
ttttgtgcatctctatgttcttcaa

SEQ ID NO: 981060 - DNA, 25 bp, Mus musculus
ttttgtgcatctgtatgttcttcaa

SEQ ID NO: 981061 - DNA, 25 bp, Mus musculus
ttttgtgcatttcgctttgttttcc

SEQ ID NO: 981062 - DNA, 25 bp, Mus musculus
ttttgtgcatttggctttgttttcc

SEQ ID NO: 981063 - DNA, 25 bp, Mus musculus
ttttgtgccggtatgtgcgtgtgcc

SEQ ID NO: 981064 - DNA, 25 bp, Mus musculus
ttttgtgccggtttgtgcgtgtgcc

SEQ ID NO: 981065 - DNA, 25 bp, Mus musculus
ttttgtgcctcaagcttgtgttttt

SEQ ID NO: 981066 - DNA, 25 bp, Mus musculus
ttttgtgcctcaattcctccatttg

SEQ ID NO: 981067 - DNA, 25 bp, Mus musculus
ttttgtgcctcatgcttgtgttttt

SEQ ID NO: 981068 - DNA, 25 bp, Mus musculus
ttttgtgcctcatttcctccatttg

SEQ ID NO: 981069 - DNA, 25 bp, Mus musculus
ttttgtgcctgtccagattgcaata

SEQ ID NO: 981070 - DNA, 25 bp, Mus musculus
ttttgtgcctgtgcagattgcaata

SEQ ID NO: 981071 - DNA, 25 bp, Mus musculus
ttttgtgcgaggctgtgtacgtata

SEQ ID NO: 981072 - DNA, 25 bp, Mus musculus
ttttgtgcgagggtgtgtacgtata

SEQ ID NO: 981073 - DNA, 25 bp, Mus musculus
ttttgtgcggatctggaacccggac

SEQ ID NO: 981074 - DNA, 25 bp, Mus musculus
ttttgtgcggatgtggaacccggac

SEQ ID NO: 981075 - DNA, 25 bp, Mus musculus
ttttgtgctaggctcaaaatgcaaa

SEQ ID NO: 981076 - DNA, 25 bp, Mus musculus
ttttgtgctagggtcaaaatgcaaa

SEQ ID NO: 981077 - DNA, 25 bp, Mus musculus
ttttgtgctcaacacccactgttat

SEQ ID NO: 981078 - DNA, 25 bp, Mus musculus
ttttgtgctcaagacccactgttat

SEQ ID NO: 981079 - DNA, 25 bp, Mus musculus
ttttgtgctggcagttctggagtaa

SEQ ID NO: 981080 - DNA, 25 bp, Mus musculus
ttttgtgctggcataggaggaagtc

SEQ ID NO: 981081 - DNA, 25 bp, Mus musculus
ttttgtgctggctgttctggagtaa

SEQ ID NO: 981082 - DNA, 25 bp, Mus musculus
ttttgtgctggcttaggaggaagtc

SEQ ID NO: 981083 - DNA, 25 bp, Mus musculus
ttttgtgcttgtcttgagccatggc

SEQ ID NO: 981084 - DNA, 25 bp, Mus musculus
ttttgtgcttgtgttgagccatggc

SEQ ID NO: 981085 - DNA, 25 bp, Mus musculus
ttttgtggaaaaaccttaatctctg

SEQ ID NO: 981086 - DNA, 25 bp, Mus musculus
ttttgtggaaaatccttaatctctg

SEQ ID NO: 981087 - DNA, 25 bp, Mus musculus
ttttgtggacagcacatgggcttct

SEQ ID NO: 981088 - DNA, 25 bp, Mus musculus
ttttgtggacaggacatgggcttct

SEQ ID NO: 981089 - DNA, 25 bp, Mus musculus
ttttgtggaccgagccaccaatcag

SEQ ID NO: 981090 - DNA, 25 bp, Mus musculus
ttttgtggaccgtgccaccaatcag

SEQ ID NO: 981091 - DNA, 25 bp, Mus musculus
ttttgtggatcaccgcctccagttc

SEQ ID NO: 981092 - DNA, 25 bp, Mus musculus
ttttgtggatcagcgcctccagttc

SEQ ID NO: 981093 - DNA, 25 bp, Mus musculus
ttttgtggcaccataaggcaattga

SEQ ID NO: 981094 - DNA, 25 bp, Mus musculus
ttttgtggcaccttaaggcaattga

SEQ ID NO: 981095 - DNA, 25 bp, Mus musculus
ttttgtggctacatccatatttgta

SEQ ID NO: 981096 - DNA, 25 bp, Mus musculus
ttttgtggctacttccatatttgta

SEQ ID NO: 981097 - DNA, 25 bp, Mus musculus
ttttgtggctgcacgtaggttccgg

SEQ ID NO: 981098 - DNA, 25 bp, Mus musculus
ttttgtggctgctcgtaggttccgg

SEQ ID NO: 981099 - DNA, 25 bp, Mus musculus
ttttgtggctggaaccggtattaag

SEQ ID NO: 981100 - DNA, 25 bp, Mus musculus
ttttgtggctggtaccggtattaag

SEQ ID NO: 981101 - DNA, 25 bp, Mus musculus
ttttgtggctttccttatttggctc

SEQ ID NO: 981102 - DNA, 25 bp, Mus musculus
ttttgtggctttgcttatttggctc

SEQ ID NO: 981103 - DNA, 25 bp, Mus musculus
ttttgtgggaatcggccctgctttt

SEQ ID NO: 981104 - DNA, 25 bp, Mus musculus
ttttgtgggaatgggccctgctttt

SEQ ID NO: 981105 - DNA, 25 bp, Mus musculus
ttttgtgggcatctgcttcactgaa

SEQ ID NO: 981106 - DNA, 25 bp, Mus musculus
ttttgtgggcatgtgcttcactgaa

SEQ ID NO: 981107 - DNA, 25 bp, Mus musculus
ttttgtgggtgcatggatcagccca

SEQ ID NO: 981108 - DNA, 25 bp, Mus musculus
ttttgtgggtgcttggatcagccca

SEQ ID NO: 981109 - DNA, 25 bp, Mus musculus
ttttgtgggttaaatgctagtcttc

SEQ ID NO: 981110 - DNA, 25 bp, Mus musculus
ttttgtgggttatatgctagtcttc

SEQ ID NO: 981111 - DNA, 25 bp, Mus musculus
ttttgtgggttcctggatcagccct

SEQ ID NO: 981112 - DNA, 25 bp, Mus musculus
ttttgtgggttcgtggatcagccct

SEQ ID NO: 981113 - DNA, 25 bp, Mus musculus
ttttgtggtaacagtgagactctaa

SEQ ID NO: 981114 - DNA, 25 bp, Mus musculus
ttttgtggtaactgtgagactctaa

SEQ ID NO: 981115 - DNA, 25 bp, Mus musculus
ttttgtggttacactacgacccatc

SEQ ID NO: 981116 - DNA, 25 bp, Mus musculus
ttttgtggttactctacgacccatc

SEQ ID NO: 981117 - DNA, 25 bp, Mus musculus
ttttgtggttctacccctataacag

SEQ ID NO: 981118 - DNA, 25 bp, Mus musculus
ttttgtggttcttcccctataacag

SEQ ID NO: 981119 - DNA, 25 bp, Mus musculus
ttttgtgtaatgcccctattttttg

SEQ ID NO: 981120 - DNA, 25 bp, Mus musculus
ttttgtgtaatggccctattttttg

SEQ ID NO: 981121 - DNA, 25 bp, Mus musculus
ttttgtgtacagattgattcctcca

SEQ ID NO: 981122 - DNA, 25 bp, Mus musculus
ttttgtgtacagtttgattcctcca

SEQ ID NO: 981123 - DNA, 25 bp, Mus musculus
ttttgtgtaccacctgcatacagtc

SEQ ID NO: 981124 - DNA, 25 bp, Mus musculus
ttttgtgtaccagctgcatacagtc

SEQ ID NO: 981125 - DNA, 25 bp, Mus musculus
ttttgtgtagacatcgtcttgcctg

SEQ ID NO: 981126 - DNA, 25 bp, Mus musculus
ttttgtgtagacttcgtcttgcctg

SEQ ID NO: 981127 - DNA, 25 bp, Mus musculus
ttttgtgtattgaacttagcattca

SEQ ID NO: 981128 - DNA, 25 bp, Mus musculus
ttttgtgtattgtacttagcattca

SEQ ID NO: 981129 - DNA, 25 bp, Mus musculus
ttttgtgtcaacaaaatcgcgtctg

SEQ ID NO: 981130 - DNA, 25 bp, Mus musculus
ttttgtgtcaactaaatcgcgtctg

SEQ ID NO: 981131 - DNA, 25 bp, Mus musculus
ttttgtgtcagtcatgagtcatcag

SEQ ID NO: 981132 - DNA, 25 bp, Mus musculus
ttttgtgtcagtgatgagtcatcag

SEQ ID NO: 981133 - DNA, 25 bp, Mus musculus
ttttgtgtccaacaccacaccggat

SEQ ID NO: 981134 - DNA, 25 bp, Mus musculus
ttttgtgtccaagaccacaccggat

SEQ ID NO: 981135 - DNA, 25 bp, Mus musculus
ttttgtgtcgtgacgtttgtttgtt

SEQ ID NO: 981136 - DNA, 25 bp, Mus musculus
ttttgtgtcgtgtcgtttgtttgtt

SEQ ID NO: 981137 - DNA, 25 bp, Mus musculus
ttttgtgtctagatggtagggcata

SEQ ID NO: 981138 - DNA, 25 bp, Mus musculus
ttttgtgtctagttggtagggcata

SEQ ID NO: 981139 - DNA, 25 bp, Mus musculus
ttttgtgtgacacgccttgccgatg

SEQ ID NO: 981140 - DNA, 25 bp, Mus musculus
ttttgtgtgacaggccttgccgatg

SEQ ID NO: 981141 - DNA, 25 bp, Mus musculus
ttttgtgtggtacctctgtgtctat

SEQ ID NO: 981142 - DNA, 25 bp, Mus musculus
ttttgtgtggtagctctgtgtctat

SEQ ID NO: 981143 - DNA, 25 bp, Mus musculus
ttttgtgtgttccaagataccctcc

SEQ ID NO: 981144 - DNA, 25 bp, Mus musculus
ttttgtgtgttcgaagataccctcc

SEQ ID NO: 981145 - DNA, 25 bp, Mus musculus
ttttgtgttcaaagaattgctcagt

SEQ ID NO: 981146 - DNA, 25 bp, Mus musculus
ttttgtgttcaatgaattgctcagt

SEQ ID NO: 981147 - DNA, 25 bp, Mus musculus
ttttgtgttcctctggctatgcact

SEQ ID NO: 981148 - DNA, 25 bp, Mus musculus
ttttgtgttcctgtggctatgcact

SEQ ID NO: 981149 - DNA, 25 bp, Mus musculus
ttttgtgttgacacttgaaaagctt

SEQ ID NO: 981150 - DNA, 25 bp, Mus musculus
ttttgtgttgactcttgaaaagctt

SEQ ID NO: 981151 - DNA, 25 bp, Mus musculus
ttttgtgttgcaacatggtcctgtg

SEQ ID NO: 981152 - DNA, 25 bp, Mus musculus
ttttgtgttgcatcatggtcctgtg

SEQ ID NO: 981153 - DNA, 25 bp, Mus musculus
ttttgtgttttccatacctatcagg

SEQ ID NO: 981154 - DNA, 25 bp, Mus musculus
ttttgtgttttcgatacctatcagg

SEQ ID NO: 981155 - DNA, 25 bp, Mus musculus
ttttgttaagcaatcaccgtccacc

SEQ ID NO: 981156 - DNA, 25 bp, Mus musculus
ttttgttaagcattcaccgtccacc

SEQ ID NO: 981157 - DNA, 25 bp, Mus musculus
ttttgttaatttacggtgctcctgt

SEQ ID NO: 981158 - DNA, 25 bp, Mus musculus
ttttgttaattttcggtgctcctgt

SEQ ID NO: 981159 - DNA, 25 bp, Mus musculus
ttttgttacaaacctgtgggcctgt

SEQ ID NO: 981160 - DNA, 25 bp, Mus musculus
ttttgttacaaagctgtgggcctgt

SEQ ID NO: 981161 - DNA, 25 bp, Mus musculus
ttttgttacacccagcccctggatg

SEQ ID NO: 981162 - DNA, 25 bp, Mus musculus
ttttgttacaccgagcccctggatg

SEQ ID NO: 981163 - DNA, 25 bp, Mus musculus
ttttgttacagcctagtagttgaga

SEQ ID NO: 981164 - DNA, 25 bp, Mus musculus
ttttgttacagcgtagtagttgaga

SEQ ID NO: 981165 - DNA, 25 bp, Mus musculus
ttttgttacattcaggaagttccct

SEQ ID NO: 981166 - DNA, 25 bp, Mus musculus
ttttgttacattgaggaagttccct

SEQ ID NO: 981167 - DNA, 25 bp, Mus musculus
ttttgttacttcatccactctgtgt

SEQ ID NO: 981168 - DNA, 25 bp, Mus musculus
ttttgttacttcttccactctgtgt

SEQ ID NO: 981169 - DNA, 25 bp, Mus musculus
ttttgttagaatatgccctgcagcc

SEQ ID NO: 981170 - DNA, 25 bp, Mus musculus
ttttgttagaatttgccctgcagcc

SEQ ID NO: 981171 - DNA, 25 bp, Mus musculus
ttttgttagcaacaactggtcactt

SEQ ID NO: 981172 - DNA, 25 bp, Mus musculus
ttttgttagcaagaactggtcactt

SEQ ID NO: 981173 - DNA, 25 bp, Mus musculus
ttttgttaggcccttgcctgtctgc

SEQ ID NO: 981174 - DNA, 25 bp, Mus musculus
ttttgttaggccgttgcctgtctgc

SEQ ID NO: 981175 - DNA, 25 bp, Mus musculus
ttttgttagttgattaggcacccac

SEQ ID NO: 981176 - DNA, 25 bp, Mus musculus
ttttgttagttgtttaggcacccac

SEQ ID NO: 981177 - DNA, 25 bp, Mus musculus
ttttgttagtttcacctcatccccg

SEQ ID NO: 981178 - DNA, 25 bp, Mus musculus
ttttgttagtttgacctcatccccg

SEQ ID NO: 981179 - DNA, 25 bp, Mus musculus
ttttgttataggcatggtccccact

SEQ ID NO: 981180 - DNA, 25 bp, Mus musculus
ttttgttatagggatggtccccact

SEQ ID NO: 981181 - DNA, 25 bp, Mus musculus
ttttgttatcttagtactttgtggg

SEQ ID NO: 981182 - DNA, 25 bp, Mus musculus
ttttgttatctttgtactttgtggg

SEQ ID NO: 981183 - DNA, 25 bp, Mus musculus
ttttgttatgctctcagcccatggc

SEQ ID NO: 981184 - DNA, 25 bp, Mus musculus
ttttgttatgctgtcagcccatggc

SEQ ID NO: 981185 - DNA, 25 bp, Mus musculus
ttttgttattgaaatctcggataca

SEQ ID NO: 981186 - DNA, 25 bp, Mus musculus
ttttgttattgatatctcggataca

SEQ ID NO: 981187 - DNA, 25 bp, Mus musculus
ttttgttcacacagatcatcttggt

SEQ ID NO: 981188 - DNA, 25 bp, Mus musculus
ttttgttcacactgatcatcttggt

SEQ ID NO: 981189 - DNA, 25 bp, Mus musculus
ttttgttcagatcgcatcactagtg

SEQ ID NO: 981190 - DNA, 25 bp, Mus musculus
ttttgttcagatggcatcactagtg

SEQ ID NO: 981191 - DNA, 25 bp, Mus musculus
ttttgttcagcaacaacctatatgt

SEQ ID NO: 981192 - DNA, 25 bp, Mus musculus
ttttgttcagcatcaacctatatgt

SEQ ID NO: 981193 - DNA, 25 bp, Mus musculus
ttttgttcataccaatgggtgtttt

SEQ ID NO: 981194 - DNA, 25 bp, Mus musculus
ttttgttcatacgaatgggtgtttt

SEQ ID NO: 981195 - DNA, 25 bp, Mus musculus
ttttgttcccctagtaagcagctga

SEQ ID NO: 981196 - DNA, 25 bp, Mus musculus
ttttgttccccttgtaagcagctga

SEQ ID NO: 981197 - DNA, 25 bp, Mus musculus
ttttgttcccttcgctgagagtgaa

SEQ ID NO: 981198 - DNA, 25 bp, Mus musculus
ttttgttcccttggctgagagtgaa

SEQ ID NO: 981199 - DNA, 25 bp, Mus musculus
ttttgttcctgtcccattagagctg

SEQ ID NO: 981200 - DNA, 25 bp, Mus musculus
ttttgttcctgtgccattagagctg

SEQ ID NO: 981201 - DNA, 25 bp, Mus musculus
ttttgttccttaactgttgagcctc

SEQ ID NO: 981202 - DNA, 25 bp, Mus musculus
ttttgttccttatctgttgagcctc

SEQ ID NO: 981203 - DNA, 25 bp, Mus musculus
ttttgttctaatattttacagccat

SEQ ID NO: 981204 - DNA, 25 bp, Mus musculus
ttttgttctaattttttacagccat

SEQ ID NO: 981205 - DNA, 25 bp, Mus musculus
ttttgttctatgacactgggaatgt

SEQ ID NO: 981206 - DNA, 25 bp, Mus musculus
ttttgttctatgtcactgggaatgt

SEQ ID NO: 981207 - DNA, 25 bp, Mus musculus
ttttgttctcttacacccgatcaaa

SEQ ID NO: 981208 - DNA, 25 bp, Mus musculus
ttttgttctctttcacccgatcaaa

SEQ ID NO: 981209 - DNA, 25 bp, Mus musculus
ttttgttctgaacagtccctcaatc

SEQ ID NO: 981210 - DNA, 25 bp, Mus musculus
ttttgttctgaagagtccctcaatc

SEQ ID NO: 981211 - DNA, 25 bp, Mus musculus
ttttgttctgttactactgccatta

SEQ ID NO: 981212 - DNA, 25 bp, Mus musculus
ttttgttctgtttctactgccatta

SEQ ID NO: 981213 - DNA, 25 bp, Mus musculus
ttttgttcttcacttccctgtgtga

SEQ ID NO: 981214 - DNA, 25 bp, Mus musculus
ttttgttcttcagttccctgtgtga

SEQ ID NO: 981215 - DNA, 25 bp, Mus musculus
ttttgttcttgacggctggcccaga

SEQ ID NO: 981216 - DNA, 25 bp, Mus musculus
ttttgttcttgagggctggcccaga

SEQ ID NO: 981217 - DNA, 25 bp, Mus musculus
ttttgttgacaaaaccccttgaggg

SEQ ID NO: 981218 - DNA, 25 bp, Mus musculus
ttttgttgacaataccccttgaggg

SEQ ID NO: 981219 - DNA, 25 bp, Mus musculus
ttttgttgagacctgatggcctgtg

SEQ ID NO: 981220 - DNA, 25 bp, Mus musculus
ttttgttgagacgtgatggcctgtg

SEQ ID NO: 981221 - DNA, 25 bp, Mus musculus
ttttgttgaggtatcgtgtgcgatt

SEQ ID NO: 981222 - DNA, 25 bp, Mus musculus
ttttgttgaggtttcgtgtgcgatt

SEQ ID NO: 981223 - DNA, 25 bp, Mus musculus
ttttgttgataaccccatttcctag

SEQ ID NO: 981224 - DNA, 25 bp, Mus musculus
ttttgttgataagcccatttcctag

SEQ ID NO: 981225 - DNA, 25 bp, Mus musculus
ttttgttgcaaaacctttatcagag

SEQ ID NO: 981226 - DNA, 25 bp, Mus musculus
ttttgttgcaaatcctttatcagag

SEQ ID NO: 981227 - DNA, 25 bp, Mus musculus
ttttgttgccaaaagtggacctctg

SEQ ID NO: 981228 - DNA, 25 bp, Mus musculus
ttttgttgccaatagtggacctctg

SEQ ID NO: 981229 - DNA, 25 bp, Mus musculus
ttttgttgcccaagggcccaatttg

SEQ ID NO: 981230 - DNA, 25 bp, Mus musculus
ttttgttgcccatgggcccaatttg

SEQ ID NO: 981231 - DNA, 25 bp, Mus musculus
ttttgttgctcccagtacatttaag

SEQ ID NO: 981232 - DNA, 25 bp, Mus musculus
ttttgttgctccgagtacatttaag

SEQ ID NO: 981233 - DNA, 25 bp, Mus musculus
ttttgttggaatcagggcctcttca

SEQ ID NO: 981234 - DNA, 25 bp, Mus musculus
ttttgttggaatgagggcctcttca

SEQ ID NO: 981235 - DNA, 25 bp, Mus musculus
ttttgttggcttattgcagttttct

SEQ ID NO: 981236 - DNA, 25 bp, Mus musculus
ttttgttggctttttgcagttttct

SEQ ID NO: 981237 - DNA, 25 bp, Mus musculus
ttttgttgggacagacaaagcacat

SEQ ID NO: 981238 - DNA, 25 bp, Mus musculus
ttttgttgggactgacaaagcacat

SEQ ID NO: 981239 - DNA, 25 bp, Mus musculus
ttttgttgtactagtgtggctgtgt

SEQ ID NO: 981240 - DNA, 25 bp, Mus musculus
ttttgttgtacttgtgtggctgtgt

SEQ ID NO: 981241 - DNA, 25 bp, Mus musculus
ttttgttgtgtcatactgcctctat

SEQ ID NO: 981242 - DNA, 25 bp, Mus musculus
ttttgttgtgtcttactgcctctat

SEQ ID NO: 981243 - DNA, 25 bp, Mus musculus
ttttgttgttaaagctgtacttcag

SEQ ID NO: 981244 - DNA, 25 bp, Mus musculus
ttttgttgttaatgctgtacttcag

SEQ ID NO: 981245 - DNA, 25 bp, Mus musculus
ttttgttgttccataggcattcatt

SEQ ID NO: 981246 - DNA, 25 bp, Mus musculus
ttttgttgttccttaggcattcatt

SEQ ID NO: 981247 - DNA, 25 bp, Mus musculus
ttttgttgttgtctcggctcctctg

SEQ ID NO: 981248 - DNA, 25 bp, Mus musculus
ttttgttgttgtgtcggctcctctg

SEQ ID NO: 981249 - DNA, 25 bp, Mus musculus
ttttgtttatgcctgtgtcccaggt

SEQ ID NO: 981250 - DNA, 25 bp, Mus musculus
ttttgtttatgcgtgtgtcccaggt

SEQ ID NO: 981251 - DNA, 25 bp, Mus musculus
ttttgtttcaccatatgctgtgaca

SEQ ID NO: 981252 - DNA, 25 bp, Mus musculus
ttttgtttcaccttatgctgtgaca

SEQ ID NO: 981253 - DNA, 25 bp, Mus musculus
ttttgtttccacactggaacaccgt

SEQ ID NO: 981254 - DNA, 25 bp, Mus musculus
ttttgtttccactctggaacaccgt

SEQ ID NO: 981255 - DNA, 25 bp, Mus musculus
ttttgtttccatcatcacttgatgt

SEQ ID NO: 981256 - DNA, 25 bp, Mus musculus
ttttgtttccatgatcacttgatgt

SEQ ID NO: 981257 - DNA, 25 bp, Mus musculus
ttttgtttccccatgtttgttatag

SEQ ID NO: 981258 - DNA, 25 bp, Mus musculus
ttttgtttccccttgtttgttatag

SEQ ID NO: 981259 - DNA, 25 bp, Mus musculus
ttttgtttccttaagactggccaag

SEQ ID NO: 981260 - DNA, 25 bp, Mus musculus
ttttgtttcctttagactggccaag

SEQ ID NO: 981261 - DNA, 25 bp, Mus musculus
ttttgtttgcccatggagtggagtg

SEQ ID NO: 981262 - DNA, 25 bp, Mus musculus
ttttgtttgcccttggagtggagtg

SEQ ID NO: 981263 - DNA, 25 bp, Mus musculus
ttttgtttgtaaccgtgtcctccta

SEQ ID NO: 981264 - DNA, 25 bp, Mus musculus
ttttgtttgtaagcgtgtcctccta

SEQ ID NO: 981265 - DNA, 25 bp, Mus musculus
ttttgtttgtcacccctcgataaag

SEQ ID NO: 981266 - DNA, 25 bp, Mus musculus
ttttgtttgtcagccctcgataaag

SEQ ID NO: 981267 - DNA, 25 bp, Mus musculus
ttttgtttgttacgtccacctctca

SEQ ID NO: 981268 - DNA, 25 bp, Mus musculus
ttttgtttgttaggtccacctctca

SEQ ID NO: 981269 - DNA, 25 bp, Mus musculus
ttttgttttcatacagactcatgta

SEQ ID NO: 981270 - DNA, 25 bp, Mus musculus
ttttgttttcattcagactcatgta

SEQ ID NO: 981271 - DNA, 25 bp, Mus musculus
ttttgttttccaattccagagactg

SEQ ID NO: 981272 - DNA, 25 bp, Mus musculus
ttttgttttccatttccagagactg

SEQ ID NO: 981273 - DNA, 25 bp, Mus musculus
ttttgttttccgctctcgaagagaa

SEQ ID NO: 981274 - DNA, 25 bp, Mus musculus
ttttgttttccggtctcgaagagaa

SEQ ID NO: 981275 - DNA, 25 bp, Mus musculus
ttttgttttctgctgcctttactta

SEQ ID NO: 981276 - DNA, 25 bp, Mus musculus
ttttgttttctggtgcctttactta

SEQ ID NO: 981277 - DNA, 25 bp, Mus musculus
ttttgttttggtcttcctcgttctg

SEQ ID NO: 981278 - DNA, 25 bp, Mus musculus
ttttgttttggtgttcctcgttctg

SEQ ID NO: 981279 - DNA, 25 bp, Mus musculus
ttttgttttgtcaatctccccattt

SEQ ID NO: 981280 - DNA, 25 bp, Mus musculus
ttttgttttgtcaggcttacctcgc

SEQ ID NO: 981281 - DNA, 25 bp, Mus musculus
ttttgttttgtctatctccccattt

SEQ ID NO: 981282 - DNA, 25 bp, Mus musculus
ttttgttttgtctggcttacctcgc

SEQ ID NO: 981283 - DNA, 25 bp, Mus musculus
ttttgtttttagcagcaccgggtgc

SEQ ID NO: 981284 - DNA, 25 bp, Mus musculus
ttttgtttttaggagcaccgggtgc

SEQ ID NO: 981285 - DNA, 25 bp, Mus musculus
ttttgtttttcaagcaccttggtga

SEQ ID NO: 981286 - DNA, 25 bp, Mus musculus
ttttgtttttcatgcaccttggtga

SEQ ID NO: 981287 - DNA, 25 bp, Mus musculus
ttttgtttttctacgccttatctgc

SEQ ID NO: 981288 - DNA, 25 bp, Mus musculus
ttttgtttttcttcgccttatctgc

SEQ ID NO: 981289 - DNA, 25 bp, Mus musculus
tttttaaaatctcaccacctcaatc

SEQ ID NO: 981290 - DNA, 25 bp, Mus musculus
tttttaaaatctgaccacctcaatc

SEQ ID NO: 981291 - DNA, 25 bp, Mus musculus
tttttaaacatcactcggagtaatg

SEQ ID NO: 981292 - DNA, 25 bp, Mus musculus
tttttaaacatctctcggagtaatg

SEQ ID NO: 981293 - DNA, 25 bp, Mus musculus
tttttaaacattacctggcactgtg

SEQ ID NO: 981294 - DNA, 25 bp, Mus musculus
tttttaaacatttcctggcactgtg

SEQ ID NO: 981295 - DNA, 25 bp, Mus musculus
tttttaaacccaactcctagcactg

SEQ ID NO: 981296 - DNA, 25 bp, Mus musculus
tttttaaacccatctcctagcactg

SEQ ID NO: 981297 - DNA, 25 bp, Mus musculus
tttttaaaccctctcaagcccatga

SEQ ID NO: 981298 - DNA, 25 bp, Mus musculus
tttttaaaccctgtcaagcccatga

SEQ ID NO: 981299 - DNA, 25 bp, Mus musculus
tttttaaagccaatccaccgtgaca

SEQ ID NO: 981300 - DNA, 25 bp, Mus musculus
tttttaaagccattccaccgtgaca

SEQ ID NO: 981301 - DNA, 25 bp, Mus musculus
tttttaaagcctagtgtgagaagcc

SEQ ID NO: 981302 - DNA, 25 bp, Mus musculus
tttttaaagccttgtgtgagaagcc

SEQ ID NO: 981303 - DNA, 25 bp, Mus musculus
tttttaaagcttctgtctgctcaga

SEQ ID NO: 981304 - DNA, 25 bp, Mus musculus
tttttaaagcttgtgtctgctcaga

SEQ ID NO: 981305 - DNA, 25 bp, Mus musculus
tttttaaatagcacctcccaccaat

SEQ ID NO: 981306 - DNA, 25 bp, Mus musculus
tttttaaatagctcctcccaccaat

SEQ ID NO: 981307 - DNA, 25 bp, Mus musculus
tttttaaattccactcgagccagta

SEQ ID NO: 981308 - DNA, 25 bp, Mus musculus
tttttaaattcctctcgagccagta

SEQ ID NO: 981309 - DNA, 25 bp, Mus musculus
tttttaaattgcacccaactcactc

SEQ ID NO: 981310 - DNA, 25 bp, Mus musculus
tttttaaattgctcccaactcactc

SEQ ID NO: 981311 - DNA, 25 bp, Mus musculus
tttttaacagttagtgtggtcacac

SEQ ID NO: 981312 - DNA, 25 bp, Mus musculus
tttttaacagtttgtgtggtcacac

SEQ ID NO: 981313 - DNA, 25 bp, Mus musculus
tttttaaccctacccattgatcatt

SEQ ID NO: 981314 - DNA, 25 bp, Mus musculus
tttttaaccctagccattgatcatt

SEQ ID NO: 981315 - DNA, 25 bp, Mus musculus
tttttaaccctcattggtgcatctg

SEQ ID NO: 981316 - DNA, 25 bp, Mus musculus
tttttaaccctctttggtgcatctg

SEQ ID NO: 981317 - DNA, 25 bp, Mus musculus
tttttaacccttaacagtgtagcag

SEQ ID NO: 981318 - DNA, 25 bp, Mus musculus
tttttaaccctttacagtgtagcag

SEQ ID NO: 981319 - DNA, 25 bp, Mus musculus
tttttaacgggaacctgtgtttgtg

SEQ ID NO: 981320 - DNA, 25 bp, Mus musculus
tttttaacgggatcctgtgtttgtg

SEQ ID NO: 981321 - DNA, 25 bp, Mus musculus
tttttaactcggactcactcggaat

SEQ ID NO: 981322 - DNA, 25 bp, Mus musculus
tttttaactcggatcaacccacagg

SEQ ID NO: 981323 - DNA, 25 bp, Mus musculus
tttttaactcggtctcactcggaat

SEQ ID NO: 981324 - DNA, 25 bp, Mus musculus
tttttaactcggttcaacccacagg

SEQ ID NO: 981325 - DNA, 25 bp, Mus musculus
tttttaactctacccttgagccaca

SEQ ID NO: 981326 - DNA, 25 bp, Mus musculus
tttttaactctagccttgagccaca

SEQ ID NO: 981327 - DNA, 25 bp, Mus musculus
tttttaagacccagacggcagctgg

SEQ ID NO: 981328 - DNA, 25 bp, Mus musculus
tttttaagaccctgacggcagctgg

SEQ ID NO: 981329 - DNA, 25 bp, Mus musculus
tttttaagcaatactatttttctag

SEQ ID NO: 981330 - DNA, 25 bp, Mus musculus
tttttaagcaattctatttttctag

SEQ ID NO: 981331 - DNA, 25 bp, Mus musculus
tttttaagctagctggaaggtgaca

SEQ ID NO: 981332 - DNA, 25 bp, Mus musculus
tttttaagctaggtggaaggtgaca

SEQ ID NO: 981333 - DNA, 25 bp, Mus musculus
tttttaagctccctactgttagatt

SEQ ID NO: 981334 - DNA, 25 bp, Mus musculus
tttttaagctccgtactgttagatt

SEQ ID NO: 981335 - DNA, 25 bp, Mus musculus
tttttaagtgctccgttttcgtgct

SEQ ID NO: 981336 - DNA, 25 bp, Mus musculus
tttttaagtgctgcgttttcgtgct

SEQ ID NO: 981337 - DNA, 25 bp, Mus musculus
tttttaatcagccaagttcacttat

SEQ ID NO: 981338 - DNA, 25 bp, Mus musculus
tttttaatcagcgaagttcacttat

SEQ ID NO: 981339 - DNA, 25 bp, Mus musculus
tttttaatcatgacacttgctattg

SEQ ID NO: 981340 - DNA, 25 bp, Mus musculus
tttttaatcatgtcacttgctattg

SEQ ID NO: 981341 - DNA, 25 bp, Mus musculus
tttttaatcccaatccaccaagtct

SEQ ID NO: 981342 - DNA, 25 bp, Mus musculus
tttttaatcccattccaccaagtct

SEQ ID NO: 981343 - DNA, 25 bp, Mus musculus
tttttaatcctccaacgtgggatgc

SEQ ID NO: 981344 - DNA, 25 bp, Mus musculus
tttttaatcctcgaacgtgggatgc

SEQ ID NO: 981345 - DNA, 25 bp, Mus musculus
tttttaatcgaacagtccctccaca

SEQ ID NO: 981346 - DNA, 25 bp, Mus musculus
tttttaatcgaagagtccctccaca

SEQ ID NO: 981347 - DNA, 25 bp, Mus musculus
tttttaatgagcctctctttcccca

SEQ ID NO: 981348 - DNA, 25 bp, Mus musculus
tttttaatgagcgtctctttcccca

SEQ ID NO: 981349 - DNA, 25 bp, Mus musculus
tttttaatgcaaaccatcgtgcggg

SEQ ID NO: 981350 - DNA, 25 bp, Mus musculus
tttttaatgcaatccatcgtgcggg

SEQ ID NO: 981351 - DNA, 25 bp, Mus musculus
tttttaatgcttccacttcattgtt

SEQ ID NO: 981352 - DNA, 25 bp, Mus musculus
tttttaatgcttgcacttcattgtt

SEQ ID NO: 981353 - DNA, 25 bp, Mus musculus
tttttaatggagagtgtcagagaat

SEQ ID NO: 981354 - DNA, 25 bp, Mus musculus
tttttaatggagctctttctctccc

SEQ ID NO: 981355 - DNA, 25 bp, Mus musculus
tttttaatggaggtctttctctccc

SEQ ID NO: 981356 - DNA, 25 bp, Mus musculus
tttttaatggagtgtgtcagagaat

SEQ ID NO: 981357 - DNA, 25 bp, Mus musculus
tttttaatgtgcctacctaaccagg

SEQ ID NO: 981358 - DNA, 25 bp, Mus musculus
tttttaatgtgcgtacctaaccagg

SEQ ID NO: 981359 - DNA, 25 bp, Mus musculus
tttttaattacaagatcctgggctc

SEQ ID NO: 981360 - DNA, 25 bp, Mus musculus
tttttaattacaccctgtctccaat

SEQ ID NO: 981361 - DNA, 25 bp, Mus musculus
tttttaattacagcctgtctccaat

SEQ ID NO: 981362 - DNA, 25 bp, Mus musculus
tttttaattacatgatcctgggctc

SEQ ID NO: 981363 - DNA, 25 bp, Mus musculus
tttttaattaccagtcagccaactt

SEQ ID NO: 981364 - DNA, 25 bp, Mus musculus
tttttaattacctgtcagccaactt

SEQ ID NO: 981365 - DNA, 25 bp, Mus musculus
tttttaattcccacaatggtcatta

SEQ ID NO: 981366 - DNA, 25 bp, Mus musculus
tttttaattccctcaatggtcatta

SEQ ID NO: 981367 - DNA, 25 bp, Mus musculus
tttttaatttgtactccctcgcatt

SEQ ID NO: 981368 - DNA, 25 bp, Mus musculus
tttttaatttgttctccctcgcatt

SEQ ID NO: 981369 - DNA, 25 bp, Mus musculus
tttttacaacaactagagctgaatg

SEQ ID NO: 981370 - DNA, 25 bp, Mus musculus
tttttacaacaagtagagctgaatg

SEQ ID NO: 981371 - DNA, 25 bp, Mus musculus
tttttacacagcagttacaattcac

SEQ ID NO: 981372 - DNA, 25 bp, Mus musculus
tttttacacagctgttacaattcac

SEQ ID NO: 981373 - DNA, 25 bp, Mus musculus
tttttacacatcagcccattaatta

SEQ ID NO: 981374 - DNA, 25 bp, Mus musculus
tttttacacatctgcccattaatta

SEQ ID NO: 981375 - DNA, 25 bp, Mus musculus
tttttacaccagaactcatcctttt

SEQ ID NO: 981376 - DNA, 25 bp, Mus musculus
tttttacaccagtactcatcctttt

SEQ ID NO: 981377 - DNA, 25 bp, Mus musculus
tttttacagaagagacagcacggct

SEQ ID NO: 981378 - DNA, 25 bp, Mus musculus
tttttacagaagtgacagcacggct

SEQ ID NO: 981379 - DNA, 25 bp, Mus musculus
tttttacagcacatggactttctaa

SEQ ID NO: 981380 - DNA, 25 bp, Mus musculus
tttttacagcacttggactttctaa

SEQ ID NO: 981381 - DNA, 25 bp, Mus musculus
tttttacataacagccttgatcctg

SEQ ID NO: 981382 - DNA, 25 bp, Mus musculus
tttttacataactgccttgatcctg

SEQ ID NO: 981383 - DNA, 25 bp, Mus musculus
tttttacatactcgccacttggaga

SEQ ID NO: 981384 - DNA, 25 bp, Mus musculus
tttttacatactggccacttggaga

SEQ ID NO: 981385 - DNA, 25 bp, Mus musculus
tttttacatataacacaggcttact

SEQ ID NO: 981386 - DNA, 25 bp, Mus musculus
tttttacatatatcacaggcttact

SEQ ID NO: 981387 - DNA, 25 bp, Mus musculus
tttttacattcacaagatgctgctg

SEQ ID NO: 981388 - DNA, 25 bp, Mus musculus
tttttacattcagaagatgctgctg

SEQ ID NO: 981389 - DNA, 25 bp, Mus musculus
tttttacatttcagcattgcaatct

SEQ ID NO: 981390 - DNA, 25 bp, Mus musculus
tttttacatttctgcattgcaatct

SEQ ID NO: 981391 - DNA, 25 bp, Mus musculus
tttttaccaagaccagtagacccag

SEQ ID NO: 981392 - DNA, 25 bp, Mus musculus
tttttaccaagagcagtagacccag

SEQ ID NO: 981393 - DNA, 25 bp, Mus musculus
tttttaccaagtccatgtgtgaatg

SEQ ID NO: 981394 - DNA, 25 bp, Mus musculus
tttttaccaagtgcatgtgtgaatg

SEQ ID NO: 981395 - DNA, 25 bp, Mus musculus
tttttaccaggtcccaatgaacaaa

SEQ ID NO: 981396 - DNA, 25 bp, Mus musculus
tttttaccaggtgccaatgaacaaa

SEQ ID NO: 981397 - DNA, 25 bp, Mus musculus
tttttaccagtgagaggcgacctca

SEQ ID NO: 981398 - DNA, 25 bp, Mus musculus
tttttaccagtgtgaggcgacctca

SEQ ID NO: 981399 - DNA, 25 bp, Mus musculus
tttttacccacacaatgtctacaag

SEQ ID NO: 981400 - DNA, 25 bp, Mus musculus
tttttacccacagaatgtctacaag

SEQ ID NO: 981401 - DNA, 25 bp, Mus musculus
tttttacccattcatttgttgattg

SEQ ID NO: 981402 - DNA, 25 bp, Mus musculus
tttttacccattgatttgttgattg

SEQ ID NO: 981403 - DNA, 25 bp, Mus musculus
tttttaccccaaagcctagagccat

SEQ ID NO: 981404 - DNA, 25 bp, Mus musculus
tttttaccccaatgcctagagccat

SEQ ID NO: 981405 - DNA, 25 bp, Mus musculus
tttttaccgcatagtggctgctcac

SEQ ID NO: 981406 - DNA, 25 bp, Mus musculus
tttttaccgcattgtggctgctcac

SEQ ID NO: 981407 - DNA, 25 bp, Mus musculus
tttttacctccaccagcaggaacag

SEQ ID NO: 981408 - DNA, 25 bp, Mus musculus
tttttacctccagcagcaggaacag

SEQ ID NO: 981409 - DNA, 25 bp, Mus musculus
tttttacctctgacaagtgagccag

SEQ ID NO: 981410 - DNA, 25 bp, Mus musculus
tttttacctctgtcaagtgagccag

SEQ ID NO: 981411 - DNA, 25 bp, Mus musculus
tttttacgcttaattttcatggatc

SEQ ID NO: 981412 - DNA, 25 bp, Mus musculus
tttttacgcttatttttcatggatc

SEQ ID NO: 981413 - DNA, 25 bp, Mus musculus
tttttacgtccgatggtgattgtac

SEQ ID NO: 981414 - DNA, 25 bp, Mus musculus
tttttacgtccgttggtgattgtac

SEQ ID NO: 981415 - DNA, 25 bp, Mus musculus
tttttacgtgagcttcccctaggcg

SEQ ID NO: 981416 - DNA, 25 bp, Mus musculus
tttttacgtgaggttcccctaggcg

SEQ ID NO: 981417 - DNA, 25 bp, Mus musculus
tttttactaccaacttttctactcg

SEQ ID NO: 981418 - DNA, 25 bp, Mus musculus
tttttactaccatcttttctactcg

SEQ ID NO: 981419 - DNA, 25 bp, Mus musculus
tttttactactgatccattgttcta

SEQ ID NO: 981420 - DNA, 25 bp, Mus musculus
tttttactactgttccattgttcta

SEQ ID NO: 981421 - DNA, 25 bp, Mus musculus
tttttactcaaccttctgatcctga

SEQ ID NO: 981422 - DNA, 25 bp, Mus musculus
tttttactcaacgttctgatcctga

SEQ ID NO: 981423 - DNA, 25 bp, Mus musculus
tttttactcacaattgtttcctgca

SEQ ID NO: 981424 - DNA, 25 bp, Mus musculus
tttttactcacatttgtttcctgca

SEQ ID NO: 981425 - DNA, 25 bp, Mus musculus
tttttactcaggctgttctcaggcg

SEQ ID NO: 981426 - DNA, 25 bp, Mus musculus
tttttactcagggtgttctcaggcg

SEQ ID NO: 981427 - DNA, 25 bp, Mus musculus
tttttactcattcaccatctcattt

SEQ ID NO: 981428 - DNA, 25 bp, Mus musculus
tttttactcattgaccatctcattt

SEQ ID NO: 981429 - DNA, 25 bp, Mus musculus
tttttactccagaatccttcccatg

SEQ ID NO: 981430 - DNA, 25 bp, Mus musculus
tttttactccagtatccttcccatg

SEQ ID NO: 981431 - DNA, 25 bp, Mus musculus
tttttactccctattgatgccatac

SEQ ID NO: 981432 - DNA, 25 bp, Mus musculus
tttttactcccttttgatgccatac

SEQ ID NO: 981433 - DNA, 25 bp, Mus musculus
tttttactctctctatctcccctat

SEQ ID NO: 981434 - DNA, 25 bp, Mus musculus
tttttactctctgtatctcccctat

SEQ ID NO: 981435 - DNA, 25 bp, Mus musculus
tttttactgaccagatgtgttggat

SEQ ID NO: 981436 - DNA, 25 bp, Mus musculus
tttttactgacctgatgtgttggat

SEQ ID NO: 981437 - DNA, 25 bp, Mus musculus
tttttactgagacactcgcttcctg

SEQ ID NO: 981438 - DNA, 25 bp, Mus musculus
tttttactgagacccgtagctcgag

SEQ ID NO: 981439 - DNA, 25 bp, Mus musculus
tttttactgagagactcgcttcctg

SEQ ID NO: 981440 - DNA, 25 bp, Mus musculus
tttttactgagagccgtagctcgag

SEQ ID NO: 981441 - DNA, 25 bp, Mus musculus
tttttactgcaactcaacccttcgt

SEQ ID NO: 981442 - DNA, 25 bp, Mus musculus
tttttactgcaagtcaacccttcgt

SEQ ID NO: 981443 - DNA, 25 bp, Mus musculus
tttttactgcacacctacaagggct

SEQ ID NO: 981444 - DNA, 25 bp, Mus musculus
tttttactgcactcctacaagggct

SEQ ID NO: 981445 - DNA, 25 bp, Mus musculus
tttttactgcttcccgtgccaaaca

SEQ ID NO: 981446 - DNA, 25 bp, Mus musculus
tttttactgcttgccgtgccaaaca

SEQ ID NO: 981447 - DNA, 25 bp, Mus musculus
tttttactggacctgcaaagctctc

SEQ ID NO: 981448 - DNA, 25 bp, Mus musculus
tttttactggacgtgcaaagctctc

SEQ ID NO: 981449 - DNA, 25 bp, Mus musculus
tttttactggtcacattggcaatgt

SEQ ID NO: 981450 - DNA, 25 bp, Mus musculus
tttttactggtctcattggcaatgt

SEQ ID NO: 981451 - DNA, 25 bp, Mus musculus
tttttactggtgaactgagtccact

SEQ ID NO: 981452 - DNA, 25 bp, Mus musculus
tttttactggtgtactgagtccact

SEQ ID NO: 981453 - DNA, 25 bp, Mus musculus
tttttactgttcctacacaaggcaa

SEQ ID NO: 981454 - DNA, 25 bp, Mus musculus
tttttactgttcgtacacaaggcaa

SEQ ID NO: 981455 - DNA, 25 bp, Mus musculus
tttttacttgctctggtcagccgaa

SEQ ID NO: 981456 - DNA, 25 bp, Mus musculus
tttttacttgctgtggtcagccgaa

SEQ ID NO: 981457 - DNA, 25 bp, Mus musculus
tttttacttggactgttgctgcaac

SEQ ID NO: 981458 - DNA, 25 bp, Mus musculus
tttttacttggagtgttgctgcaac

SEQ ID NO: 981459 - DNA, 25 bp, Mus musculus
tttttactttatacattcagctctg

SEQ ID NO: 981460 - DNA, 25 bp, Mus musculus
tttttactttattcattcagctctg

SEQ ID NO: 981461 - DNA, 25 bp, Mus musculus
tttttactttctcttcgatcaaatt

SEQ ID NO: 981462 - DNA, 25 bp, Mus musculus
tttttactttctgttcgatcaaatt

SEQ ID NO: 981463 - DNA, 25 bp, Mus musculus
tttttagaaataagcccagagtaag

SEQ ID NO: 981464 - DNA, 25 bp, Mus musculus
tttttagaaatatgcccagagtaag

SEQ ID NO: 981465 - DNA, 25 bp, Mus musculus
tttttagaacagaagggactcgtat

SEQ ID NO: 981466 - DNA, 25 bp, Mus musculus
tttttagaacagtagggactcgtat

SEQ ID NO: 981467 - DNA, 25 bp, Mus musculus
tttttagaagcccactccacttgat

SEQ ID NO: 981468 - DNA, 25 bp, Mus musculus
tttttagaagccgactccacttgat

SEQ ID NO: 981469 - DNA, 25 bp, Mus musculus
tttttagacatcaggtcccaacctg

SEQ ID NO: 981470 - DNA, 25 bp, Mus musculus
tttttagacatctggtcccaacctg

SEQ ID NO: 981471 - DNA, 25 bp, Mus musculus
tttttagacccacatcacattgtgt

SEQ ID NO: 981472 - DNA, 25 bp, Mus musculus
tttttagacccagatcacattgtgt

SEQ ID NO: 981473 - DNA, 25 bp, Mus musculus
tttttagcaaaactctccctctccg

SEQ ID NO: 981474 - DNA, 25 bp, Mus musculus
tttttagcaaaagtctccctctccg

SEQ ID NO: 981475 - DNA, 25 bp, Mus musculus
tttttagcacttcatacacagaagc

SEQ ID NO: 981476 - DNA, 25 bp, Mus musculus
tttttagcacttgatacacagaagc

SEQ ID NO: 981477 - DNA, 25 bp, Mus musculus
tttttagcagacaggacaactagtc

SEQ ID NO: 981478 - DNA, 25 bp, Mus musculus
tttttagcagactggacaactagtc

SEQ ID NO: 981479 - DNA, 25 bp, Mus musculus
tttttagcagcccactttctgtaca

SEQ ID NO: 981480 - DNA, 25 bp, Mus musculus
tttttagcagccgactttctgtaca

SEQ ID NO: 981481 - DNA, 25 bp, Mus musculus
tttttagcagttaaatgggtacatt

SEQ ID NO: 981482 - DNA, 25 bp, Mus musculus
tttttagcagtttaatgggtacatt

SEQ ID NO: 981483 - DNA, 25 bp, Mus musculus
tttttagccagactctttccaatct

SEQ ID NO: 981484 - DNA, 25 bp, Mus musculus
tttttagccagagtctttccaatct

SEQ ID NO: 981485 - DNA, 25 bp, Mus musculus
tttttagcccttacaagaactctgg

SEQ ID NO: 981486 - DNA, 25 bp, Mus musculus
tttttagccctttcaagaactctgg

SEQ ID NO: 981487 - DNA, 25 bp, Mus musculus
tttttagcgttgagttgtattccca

SEQ ID NO: 981488 - DNA, 25 bp, Mus musculus
tttttagcgttgtgttgtattccca

SEQ ID NO: 981489 - DNA, 25 bp, Mus musculus
tttttagctaacatggaaattggaa

SEQ ID NO: 981490 - DNA, 25 bp, Mus musculus
tttttagctaacttggaaattggaa

SEQ ID NO: 981491 - DNA, 25 bp, Mus musculus
tttttagctcctcgcatacatgtgc

SEQ ID NO: 981492 - DNA, 25 bp, Mus musculus
tttttagctcctggcatacatgtgc

SEQ ID NO: 981493 - DNA, 25 bp, Mus musculus
tttttagctgttagtgcagtccctc

SEQ ID NO: 981494 - DNA, 25 bp, Mus musculus
tttttagctgtttgtgcagtccctc

SEQ ID NO: 981495 - DNA, 25 bp, Mus musculus
tttttaggactcaattagtcagcat

SEQ ID NO: 981496 - DNA, 25 bp, Mus musculus
tttttaggactctattagtcagcat

SEQ ID NO: 981497 - DNA, 25 bp, Mus musculus
tttttaggatgcacgtgtgtggaac

SEQ ID NO: 981498 - DNA, 25 bp, Mus musculus
tttttaggatgctcgtgtgtggaac

SEQ ID NO: 981499 - DNA, 25 bp, Mus musculus
tttttaggccccacagacagtggtg

SEQ ID NO: 981500 - DNA, 25 bp, Mus musculus
tttttaggcccctcagacagtggtg

SEQ ID NO: 981501 - DNA, 25 bp, Mus musculus
tttttaggccctctcatcaaagctg

SEQ ID NO: 981502 - DNA, 25 bp, Mus musculus
tttttaggccctgtcatcaaagctg

SEQ ID NO: 981503 - DNA, 25 bp, Mus musculus
tttttagggctaaacacattgccaa

SEQ ID NO: 981504 - DNA, 25 bp, Mus musculus
tttttagggctatacacattgccaa

SEQ ID NO: 981505 - DNA, 25 bp, Mus musculus
tttttaggtctcaagctacccacaa

SEQ ID NO: 981506 - DNA, 25 bp, Mus musculus
tttttaggtctctagctacccacaa

SEQ ID NO: 981507 - DNA, 25 bp, Mus musculus
tttttagtagctaggtgccatggat

SEQ ID NO: 981508 - DNA, 25 bp, Mus musculus
tttttagtagcttggtgccatggat

SEQ ID NO: 981509 - DNA, 25 bp, Mus musculus
tttttagtatttctcttccacatga

SEQ ID NO: 981510 - DNA, 25 bp, Mus musculus
tttttagtatttgtcttccacatga

SEQ ID NO: 981511 - DNA, 25 bp, Mus musculus
tttttagtcattctgggctactcaa

SEQ ID NO: 981512 - DNA, 25 bp, Mus musculus
tttttagtcattgtgggctactcaa

SEQ ID NO: 981513 - DNA, 25 bp, Mus musculus
tttttagtctctatcatatctttga

SEQ ID NO: 981514 - DNA, 25 bp, Mus musculus
tttttagtctctttcatatctttga

SEQ ID NO: 981515 - DNA, 25 bp, Mus musculus
tttttagtgtggatgacccgtgttc

SEQ ID NO: 981516 - DNA, 25 bp, Mus musculus
tttttagtgtggttgacccgtgttc

SEQ ID NO: 981517 - DNA, 25 bp, Mus musculus
tttttagttcagaccacaacaaaag

SEQ ID NO: 981518 - DNA, 25 bp, Mus musculus
tttttagttcagtccacaacaaaag

SEQ ID NO: 981519 - DNA, 25 bp, Mus musculus
tttttagttcatctcctttcacgct

SEQ ID NO: 981520 - DNA, 25 bp, Mus musculus
tttttagttcatgtcctttcacgct

SEQ ID NO: 981521 - DNA, 25 bp, Mus musculus
tttttataccacacaaaccctgctt

SEQ ID NO: 981522 - DNA, 25 bp, Mus musculus
tttttataccactcaaaccctgctt

SEQ ID NO: 981523 - DNA, 25 bp, Mus musculus
tttttataccatcatccgctgcctg

SEQ ID NO: 981524 - DNA, 25 bp, Mus musculus
tttttataccatgatccgctgcctg

SEQ ID NO: 981525 - DNA, 25 bp, Mus musculus
tttttatactacactgatgctgctt

SEQ ID NO: 981526 - DNA, 25 bp, Mus musculus
tttttatactactctgatgctgctt

SEQ ID NO: 981527 - DNA, 25 bp, Mus musculus
tttttatactgcacagtggcacaca

SEQ ID NO: 981528 - DNA, 25 bp, Mus musculus
tttttatactgctcagtggcacaca

SEQ ID NO: 981529 - DNA, 25 bp, Mus musculus
tttttatatgcaactcttctccact

SEQ ID NO: 981530 - DNA, 25 bp, Mus musculus
tttttatatgcatctcttctccact

SEQ ID NO: 981531 - DNA, 25 bp, Mus musculus
tttttatcagccagtcttgtcccga

SEQ ID NO: 981532 - DNA, 25 bp, Mus musculus
tttttatcagcctgtcttgtcccga

SEQ ID NO: 981533 - DNA, 25 bp, Mus musculus
tttttatcatatcctacctttccca

SEQ ID NO: 981534 - DNA, 25 bp, Mus musculus
tttttatcatatgctacctttccca

SEQ ID NO: 981535 - DNA, 25 bp, Mus musculus
tttttatcatgtatttctcctcccc

SEQ ID NO: 981536 - DNA, 25 bp, Mus musculus
tttttatcatgtttttctcctcccc

SEQ ID NO: 981537 - DNA, 25 bp, Mus musculus
tttttatccctgctctgaattttag

SEQ ID NO: 981538 - DNA, 25 bp, Mus musculus
tttttatccctggtctgaattttag

SEQ ID NO: 981539 - DNA, 25 bp, Mus musculus
tttttatcgtgtccgtgtaccatat

SEQ ID NO: 981540 - DNA, 25 bp, Mus musculus
tttttatcgtgtgcgtgtaccatat

SEQ ID NO: 981541 - DNA, 25 bp, Mus musculus
tttttatctctcatatccacagggc

SEQ ID NO: 981542 - DNA, 25 bp, Mus musculus
tttttatctctcttatccacagggc

SEQ ID NO: 981543 - DNA, 25 bp, Mus musculus
tttttatcttttcggcttgctgtac

SEQ ID NO: 981544 - DNA, 25 bp, Mus musculus
tttttatcttttgggcttgctgtac

SEQ ID NO: 981545 - DNA, 25 bp, Mus musculus
tttttatgaaggctttgacaaccag

SEQ ID NO: 981546 - DNA, 25 bp, Mus musculus
tttttatgaagggtttgacaaccag

SEQ ID NO: 981547 - DNA, 25 bp, Mus musculus
tttttatgacacagggatggaaccc

SEQ ID NO: 981548 - DNA, 25 bp, Mus musculus
tttttatgacactgggatggaaccc

SEQ ID NO: 981549 - DNA, 25 bp, Mus musculus
tttttatgatcccagcctagagctc

SEQ ID NO: 981550 - DNA, 25 bp, Mus musculus
tttttatgatccgagcctagagctc

SEQ ID NO: 981551 - DNA, 25 bp, Mus musculus
tttttatgcatgacactaagttgtc

SEQ ID NO: 981552 - DNA, 25 bp, Mus musculus
tttttatgcatgtcactaagttgtc

SEQ ID NO: 981553 - DNA, 25 bp, Mus musculus
tttttatggagcctcaactgtcctg

SEQ ID NO: 981554 - DNA, 25 bp, Mus musculus
tttttatggagcgtcaactgtcctg

SEQ ID NO: 981555 - DNA, 25 bp, Mus musculus
tttttatggttaaatctggcccctc

SEQ ID NO: 981556 - DNA, 25 bp, Mus musculus
tttttatggttatatctggcccctc

SEQ ID NO: 981557 - DNA, 25 bp, Mus musculus
tttttatgtacaaccctgaccctga

SEQ ID NO: 981558 - DNA, 25 bp, Mus musculus
tttttatgtacatccctgaccctga

SEQ ID NO: 981559 - DNA, 25 bp, Mus musculus
tttttatgtatccaaatgctagcac

SEQ ID NO: 981560 - DNA, 25 bp, Mus musculus
tttttatgtatcgaaatgctagcac

SEQ ID NO: 981561 - DNA, 25 bp, Mus musculus
tttttatgtccaaggtccccggtga

SEQ ID NO: 981562 - DNA, 25 bp, Mus musculus
tttttatgtccatggtccccggtga

SEQ ID NO: 981563 - DNA, 25 bp, Mus musculus
tttttatgtctgaacccaatcctta

SEQ ID NO: 981564 - DNA, 25 bp, Mus musculus
tttttatgtctgtacccaatcctta

SEQ ID NO: 981565 - DNA, 25 bp, Mus musculus
tttttatgtgtcagttgtttcccct

SEQ ID NO: 981566 - DNA, 25 bp, Mus musculus
tttttatgtgtctgttgtttcccct

SEQ ID NO: 981567 - DNA, 25 bp, Mus musculus
tttttattacccactggacatctcc

SEQ ID NO: 981568 - DNA, 25 bp, Mus musculus
tttttattaccctctggacatctcc

SEQ ID NO: 981569 - DNA, 25 bp, Mus musculus
tttttattatacacgaacaccttag

SEQ ID NO: 981570 - DNA, 25 bp, Mus musculus
tttttattatactcgaacaccttag

SEQ ID NO: 981571 - DNA, 25 bp, Mus musculus
tttttattcaccactttccttatca

SEQ ID NO: 981572 - DNA, 25 bp, Mus musculus
tttttattcacctctttccttatca

SEQ ID NO: 981573 - DNA, 25 bp, Mus musculus
tttttattccaacctgaccagtaag

SEQ ID NO: 981574 - DNA, 25 bp, Mus musculus
tttttattccaagctgaccagtaag

SEQ ID NO: 981575 - DNA, 25 bp, Mus musculus
tttttattgaggctgcagggcgctt

SEQ ID NO: 981576 - DNA, 25 bp, Mus musculus
tttttattgagggtgcagggcgctt

SEQ ID NO: 981577 - DNA, 25 bp, Mus musculus
tttttattgcctctggaattttgtc

SEQ ID NO: 981578 - DNA, 25 bp, Mus musculus
tttttattgcctgtggaattttgtc

SEQ ID NO: 981579 - DNA, 25 bp, Mus musculus
tttttattgctgattaagatggtca

SEQ ID NO: 981580 - DNA, 25 bp, Mus musculus
tttttattgctgtttaagatggtca

SEQ ID NO: 981581 - DNA, 25 bp, Mus musculus
tttttattgtcaattggtgagaagt

SEQ ID NO: 981582 - DNA, 25 bp, Mus musculus
tttttattgtcatttggtgagaagt

SEQ ID NO: 981583 - DNA, 25 bp, Mus musculus
tttttattgttccaaagctttagtg

SEQ ID NO: 981584 - DNA, 25 bp, Mus musculus
tttttattgttcgaaagctttagtg

SEQ ID NO: 981585 - DNA, 25 bp, Mus musculus
tttttatttctgagttgctctccat

SEQ ID NO: 981586 - DNA, 25 bp, Mus musculus
tttttatttctgtgttgctctccat

SEQ ID NO: 981587 - DNA, 25 bp, Mus musculus
tttttatttggtagcaggtgttaat

SEQ ID NO: 981588 - DNA, 25 bp, Mus musculus
tttttatttggttgcaggtgttaat

SEQ ID NO: 981589 - DNA, 25 bp, Mus musculus
tttttattttctattcacctgcccg

SEQ ID NO: 981590 - DNA, 25 bp, Mus musculus
tttttattttcttttcacctgcccg

SEQ ID NO: 981591 - DNA, 25 bp, Mus musculus
tttttcaaacctccagtagccagac

SEQ ID NO: 981592 - DNA, 25 bp, Mus musculus
tttttcaaacctgcagtagccagac

SEQ ID NO: 981593 - DNA, 25 bp, Mus musculus
tttttcaaactgaccttccttctgc

SEQ ID NO: 981594 - DNA, 25 bp, Mus musculus
tttttcaaactgtccttccttctgc

SEQ ID NO: 981595 - DNA, 25 bp, Mus musculus
tttttcaaagaccacacactgatct

SEQ ID NO: 981596 - DNA, 25 bp, Mus musculus
tttttcaaagacgacacactgatct

SEQ ID NO: 981597 - DNA, 25 bp, Mus musculus
tttttcaacattaggatatctggac

SEQ ID NO: 981598 - DNA, 25 bp, Mus musculus
tttttcaacatttggatatctggac

SEQ ID NO: 981599 - DNA, 25 bp, Mus musculus
tttttcaaccaaatccagcctcaga

SEQ ID NO: 981600 - DNA, 25 bp, Mus musculus
tttttcaaccaattccagcctcaga

SEQ ID NO: 981601 - DNA, 25 bp, Mus musculus
tttttcaacctcataaaccttcctg

SEQ ID NO: 981602 - DNA, 25 bp, Mus musculus
tttttcaacctcttaaaccttcctg

SEQ ID NO: 981603 - DNA, 25 bp, Mus musculus
tttttcaagcagattgcacattttt

SEQ ID NO: 981604 - DNA, 25 bp, Mus musculus
tttttcaagcagtttgcacattttt

SEQ ID NO: 981605 - DNA, 25 bp, Mus musculus
tttttcaagtaactctttgtcctga

SEQ ID NO: 981606 - DNA, 25 bp, Mus musculus
tttttcaagtaagtctttgtcctga

SEQ ID NO: 981607 - DNA, 25 bp, Mus musculus
tttttcaataacagtgacctcctgc

SEQ ID NO: 981608 - DNA, 25 bp, Mus musculus
tttttcaataactgtgacctcctgc

SEQ ID NO: 981609 - DNA, 25 bp, Mus musculus
tttttcaatatcaaggacactctcc

SEQ ID NO: 981610 - DNA, 25 bp, Mus musculus
tttttcaatatctaggacactctcc

SEQ ID NO: 981611 - DNA, 25 bp, Mus musculus
tttttcaatcagaaaggcatttcct

SEQ ID NO: 981612 - DNA, 25 bp, Mus musculus
tttttcaatcagtaaggcatttcct

SEQ ID NO: 981613 - DNA, 25 bp, Mus musculus
tttttcaatgaacgtataagctatg

SEQ ID NO: 981614 - DNA, 25 bp, Mus musculus
tttttcaatgaaggtataagctatg

SEQ ID NO: 981615 - DNA, 25 bp, Mus musculus
tttttcaccagcctcatggctcagt

SEQ ID NO: 981616 - DNA, 25 bp, Mus musculus
tttttcaccagcctttccagcaggt

SEQ ID NO: 981617 - DNA, 25 bp, Mus musculus
tttttcaccagcgtcatggctcagt

SEQ ID NO: 981618 - DNA, 25 bp, Mus musculus
tttttcaccagcgtttccagcaggt

SEQ ID NO: 981619 - DNA, 25 bp, Mus musculus
tttttcaccctccttcgctctcaat

SEQ ID NO: 981620 - DNA, 25 bp, Mus musculus
tttttcaccctcgttcgctctcaat

SEQ ID NO: 981621 - DNA, 25 bp, Mus musculus
tttttcacctcaaccgcatatgatt

SEQ ID NO: 981622 - DNA, 25 bp, Mus musculus
tttttcacctcatccgcatatgatt

SEQ ID NO: 981623 - DNA, 25 bp, Mus musculus
tttttcaccttgcactccctgaatc

SEQ ID NO: 981624 - DNA, 25 bp, Mus musculus
tttttcaccttggactccctgaatc

SEQ ID NO: 981625 - DNA, 25 bp, Mus musculus
tttttcacgaaaagccacagggttg

SEQ ID NO: 981626 - DNA, 25 bp, Mus musculus
tttttcacgaaatgccacagggttg

SEQ ID NO: 981627 - DNA, 25 bp, Mus musculus
tttttcactcccactatttatttat

SEQ ID NO: 981628 - DNA, 25 bp, Mus musculus
tttttcactccctctatttatttat

SEQ ID NO: 981629 - DNA, 25 bp, Mus musculus
tttttcactggcactcatcatcctg

SEQ ID NO: 981630 - DNA, 25 bp, Mus musculus
tttttcactggctctcatcatcctg

SEQ ID NO: 981631 - DNA, 25 bp, Mus musculus
tttttcacttggcagaggtgaggaa

SEQ ID NO: 981632 - DNA, 25 bp, Mus musculus
tttttcacttgggagaggtgaggaa

SEQ ID NO: 981633 - DNA, 25 bp, Mus musculus
tttttcagaagaagtactcgcctac

SEQ ID NO: 981634 - DNA, 25 bp, Mus musculus
tttttcagaagatgtactcgcctac

SEQ ID NO: 981635 - DNA, 25 bp, Mus musculus
tttttcagaccaacagccagtgctc

SEQ ID NO: 981636 - DNA, 25 bp, Mus musculus
tttttcagaccatcagccagtgctc

SEQ ID NO: 981637 - DNA, 25 bp, Mus musculus
tttttcagactgcagctcctggtgc

SEQ ID NO: 981638 - DNA, 25 bp, Mus musculus
tttttcagactggagctcctggtgc

SEQ ID NO: 981639 - DNA, 25 bp, Mus musculus
tttttcagagccagggtcaaacact

SEQ ID NO: 981640 - DNA, 25 bp, Mus musculus
tttttcagagcctgggtcaaacact

SEQ ID NO: 981641 - DNA, 25 bp, Mus musculus
tttttcagatgtctggtaattgccc

SEQ ID NO: 981642 - DNA, 25 bp, Mus musculus
tttttcagatgtgtggtaattgccc

SEQ ID NO: 981643 - DNA, 25 bp, Mus musculus
tttttcagcacaaacagcttttgaa

SEQ ID NO: 981644 - DNA, 25 bp, Mus musculus
tttttcagcacatacagcttttgaa

SEQ ID NO: 981645 - DNA, 25 bp, Mus musculus
tttttcagccaaaggtggtctctta

SEQ ID NO: 981646 - DNA, 25 bp, Mus musculus
tttttcagccaatggtggtctctta

SEQ ID NO: 981647 - DNA, 25 bp, Mus musculus
tttttcagccataaccaaccaaggt

SEQ ID NO: 981648 - DNA, 25 bp, Mus musculus
tttttcagccattaccaaccaaggt

SEQ ID NO: 981649 - DNA, 25 bp, Mus musculus
tttttcagccgcatcagtacccgaa

SEQ ID NO: 981650 - DNA, 25 bp, Mus musculus
tttttcagccgcttcagtacccgaa

SEQ ID NO: 981651 - DNA, 25 bp, Mus musculus
tttttcagctgcaggttgtttctgt

SEQ ID NO: 981652 - DNA, 25 bp, Mus musculus
tttttcagctgctggttgtttctgt

SEQ ID NO: 981653 - DNA, 25 bp, Mus musculus
tttttcagcttgctataaccccttc

SEQ ID NO: 981654 - DNA, 25 bp, Mus musculus
tttttcagcttggtataaccccttc

SEQ ID NO: 981655 - DNA, 25 bp, Mus musculus
tttttcaggacaccccacacattgc

SEQ ID NO: 981656 - DNA, 25 bp, Mus musculus
tttttcaggacagcccacacattgc

SEQ ID NO: 981657 - DNA, 25 bp, Mus musculus
tttttcagtgtcatgtgctcaccta

SEQ ID NO: 981658 - DNA, 25 bp, Mus musculus
tttttcagtgtcttgtgctcaccta

SEQ ID NO: 981659 - DNA, 25 bp, Mus musculus
tttttcagtgttcggaattaactca

SEQ ID NO: 981660 - DNA, 25 bp, Mus musculus
tttttcagtgttgggaattaactca

SEQ ID NO: 981661 - DNA, 25 bp, Mus musculus
tttttcataattctggataagttcc

SEQ ID NO: 981662 - DNA, 25 bp, Mus musculus
tttttcataattgtggataagttcc

SEQ ID NO: 981663 - DNA, 25 bp, Mus musculus
tttttcatacacagactgttatttt

SEQ ID NO: 981664 - DNA, 25 bp, Mus musculus
tttttcatacactgactgttatttt

SEQ ID NO: 981665 - DNA, 25 bp, Mus musculus
tttttcatatctccctcctctctta

SEQ ID NO: 981666 - DNA, 25 bp, Mus musculus
tttttcatatctgcctcctctctta

SEQ ID NO: 981667 - DNA, 25 bp, Mus musculus
tttttcatcatcattcctacaacct

SEQ ID NO: 981668 - DNA, 25 bp, Mus musculus
tttttcatcatctttcctacaacct

SEQ ID NO: 981669 - DNA, 25 bp, Mus musculus
tttttcatccagagcagaacgttca

SEQ ID NO: 981670 - DNA, 25 bp, Mus musculus
tttttcatccagtgcagaacgttca

SEQ ID NO: 981671 - DNA, 25 bp, Mus musculus
tttttcatccggcttcacgacagct

SEQ ID NO: 981672 - DNA, 25 bp, Mus musculus
tttttcatccgggttcacgacagct

SEQ ID NO: 981673 - DNA, 25 bp, Mus musculus
tttttcatgccacgttattaaagat

SEQ ID NO: 981674 - DNA, 25 bp, Mus musculus
tttttcatgccaggttattaaagat

SEQ ID NO: 981675 - DNA, 25 bp, Mus musculus
tttttcatggacctagaaagccttt

SEQ ID NO: 981676 - DNA, 25 bp, Mus musculus
tttttcatggacgtagaaagccttt

SEQ ID NO: 981677 - DNA, 25 bp, Mus musculus
tttttcatggatcaaaaattcccag

SEQ ID NO: 981678 - DNA, 25 bp, Mus musculus
tttttcatggatgaaaaattcccag

SEQ ID NO: 981679 - DNA, 25 bp, Mus musculus
tttttcatgtccagcccctgatgtg

SEQ ID NO: 981680 - DNA, 25 bp, Mus musculus
tttttcatgtcctgcccctgatgtg

SEQ ID NO: 981681 - DNA, 25 bp, Mus musculus
tttttcatgtggaagaacacctgga

SEQ ID NO: 981682 - DNA, 25 bp, Mus musculus
tttttcatgtggtagaacacctgga

SEQ ID NO: 981683 - DNA, 25 bp, Mus musculus
tttttcattactatgctaccacctc

SEQ ID NO: 981684 - DNA, 25 bp, Mus musculus
tttttcattactttgctaccacctc

SEQ ID NO: 981685 - DNA, 25 bp, Mus musculus
tttttcattagaactcacccacgcc

SEQ ID NO: 981686 - DNA, 25 bp, Mus musculus
tttttcattagatctcacccacgcc

SEQ ID NO: 981687 - DNA, 25 bp, Mus musculus
tttttcattaggaccatatctccaa

SEQ ID NO: 981688 - DNA, 25 bp, Mus musculus
tttttcattaggtccatatctccaa

SEQ ID NO: 981689 - DNA, 25 bp, Mus musculus
tttttcattcacatacctcacacaa

SEQ ID NO: 981690 - DNA, 25 bp, Mus musculus
tttttcattcacttacctcacacaa

SEQ ID NO: 981691 - DNA, 25 bp, Mus musculus
tttttcattctcagtttgctagcta

SEQ ID NO: 981692 - DNA, 25 bp, Mus musculus
tttttcattctctgtttgctagcta

SEQ ID NO: 981693 - DNA, 25 bp, Mus musculus
tttttccaacacaaaccaccagcat

SEQ ID NO: 981694 - DNA, 25 bp, Mus musculus
tttttccaacactaaccaccagcat

SEQ ID NO: 981695 - DNA, 25 bp, Mus musculus
tttttccaaccaacatggccttatc

SEQ ID NO: 981696 - DNA, 25 bp, Mus musculus
tttttccaaccatcatggccttatc

SEQ ID NO: 981697 - DNA, 25 bp, Mus musculus
tttttccacaatagcactgctctac

SEQ ID NO: 981698 - DNA, 25 bp, Mus musculus
tttttccacaatcaacccaagggat

SEQ ID NO: 981699 - DNA, 25 bp, Mus musculus
tttttccacaatgaacccaagggat

SEQ ID NO: 981700 - DNA, 25 bp, Mus musculus
tttttccacaattgcactgctctac

SEQ ID NO: 981701 - DNA, 25 bp, Mus musculus
tttttccaccctctaaaatcaggct

SEQ ID NO: 981702 - DNA, 25 bp, Mus musculus
tttttccaccctgtaaaatcaggct

SEQ ID NO: 981703 - DNA, 25 bp, Mus musculus
tttttccactacaccgagacagata

SEQ ID NO: 981704 - DNA, 25 bp, Mus musculus
tttttccactactccgagacagata

SEQ ID NO: 981705 - DNA, 25 bp, Mus musculus
tttttccactgaagtccaggacaca

SEQ ID NO: 981706 - DNA, 25 bp, Mus musculus
tttttccactgatgtccaggacaca

SEQ ID NO: 981707 - DNA, 25 bp, Mus musculus
tttttccactgtacccaacaatagc

SEQ ID NO: 981708 - DNA, 25 bp, Mus musculus
tttttccactgttcccaacaatagc

SEQ ID NO: 981709 - DNA, 25 bp, Mus musculus
tttttccagacaccgtctcactatt

SEQ ID NO: 981710 - DNA, 25 bp, Mus musculus
tttttccagacagcgtctcactatt

SEQ ID NO: 981711 - DNA, 25 bp, Mus musculus
tttttccagctcacctgttttgtcg

SEQ ID NO: 981712 - DNA, 25 bp, Mus musculus
tttttccagctctcctgttttgtcg

SEQ ID NO: 981713 - DNA, 25 bp, Mus musculus
tttttccaggagacaatcgctttca

SEQ ID NO: 981714 - DNA, 25 bp, Mus musculus
tttttccaggagtcaatcgctttca

SEQ ID NO: 981715 - DNA, 25 bp, Mus musculus
tttttccaggatccgcttgcagacc

SEQ ID NO: 981716 - DNA, 25 bp, Mus musculus
tttttccaggatgcgcttgcagacc

SEQ ID NO: 981717 - DNA, 25 bp, Mus musculus
tttttccaggctagtctatggcttt

SEQ ID NO: 981718 - DNA, 25 bp, Mus musculus
tttttccaggcttgtctatggcttt

SEQ ID NO: 981719 - DNA, 25 bp, Mus musculus
tttttccaggtacagcctcacatct

SEQ ID NO: 981720 - DNA, 25 bp, Mus musculus
tttttccaggtagagcctcacatct

SEQ ID NO: 981721 - DNA, 25 bp, Mus musculus
tttttccagtggcagacagtgtcta

SEQ ID NO: 981722 - DNA, 25 bp, Mus musculus
tttttccagtgggagacagtgtcta

SEQ ID NO: 981723 - DNA, 25 bp, Mus musculus
tttttccatattaaagcagtacagt

SEQ ID NO: 981724 - DNA, 25 bp, Mus musculus
tttttccatatttaagcagtacagt

SEQ ID NO: 981725 - DNA, 25 bp, Mus musculus
tttttccatcctagctcagaggcag

SEQ ID NO: 981726 - DNA, 25 bp, Mus musculus
tttttccatccttgctcagaggcag

SEQ ID NO: 981727 - DNA, 25 bp, Mus musculus
tttttccattctattctcactgtgg

SEQ ID NO: 981728 - DNA, 25 bp, Mus musculus
tttttccattcttttctcactgtgg

SEQ ID NO: 981729 - DNA, 25 bp, Mus musculus
tttttcccaaccacttagaaatgca

SEQ ID NO: 981730 - DNA, 25 bp, Mus musculus
tttttcccaacctcttagaaatgca

SEQ ID NO: 981731 - DNA, 25 bp, Mus musculus
tttttcccaagacagtgcccagtac

SEQ ID NO: 981732 - DNA, 25 bp, Mus musculus
tttttcccaagagagtgcccagtac

SEQ ID NO: 981733 - DNA, 25 bp, Mus musculus
tttttcccacttcgattatgttgat

SEQ ID NO: 981734 - DNA, 25 bp, Mus musculus
tttttcccacttggattatgttgat

SEQ ID NO: 981735 - DNA, 25 bp, Mus musculus
tttttcccagaaatgttgcccaaga

SEQ ID NO: 981736 - DNA, 25 bp, Mus musculus
tttttcccagaattgttgcccaaga

SEQ ID NO: 981737 - DNA, 25 bp, Mus musculus
tttttcccagacacaacttccaggt

SEQ ID NO: 981738 - DNA, 25 bp, Mus musculus
tttttcccagactcaacttccaggt

SEQ ID NO: 981739 - DNA, 25 bp, Mus musculus
tttttcccagccaggcttcaaacta

SEQ ID NO: 981740 - DNA, 25 bp, Mus musculus
tttttcccagcctggcttcaaacta

SEQ ID NO: 981741 - DNA, 25 bp, Mus musculus
tttttcccaggtaatcagcatcggg

SEQ ID NO: 981742 - DNA, 25 bp, Mus musculus
tttttcccaggttatcagcatcggg

SEQ ID NO: 981743 - DNA, 25 bp, Mus musculus
tttttcccagttctctagcctccaa

SEQ ID NO: 981744 - DNA, 25 bp, Mus musculus
tttttcccagttgtctagcctccaa

SEQ ID NO: 981745 - DNA, 25 bp, Mus musculus
tttttcccatgacctcatggagtag

SEQ ID NO: 981746 - DNA, 25 bp, Mus musculus
tttttcccatgagctcatggagtag

SEQ ID NO: 981747 - DNA, 25 bp, Mus musculus
tttttccccagacttgttggcgtag

SEQ ID NO: 981748 - DNA, 25 bp, Mus musculus
tttttccccagagttgttggcgtag

SEQ ID NO: 981749 - DNA, 25 bp, Mus musculus
tttttccccaggacactttgcttca

SEQ ID NO: 981750 - DNA, 25 bp, Mus musculus
tttttccccaggtcactttgcttca

SEQ ID NO: 981751 - DNA, 25 bp, Mus musculus
tttttccccattcgtcactttcctg

SEQ ID NO: 981752 - DNA, 25 bp, Mus musculus
tttttccccattggtcactttcctg

SEQ ID NO: 981753 - DNA, 25 bp, Mus musculus
tttttcccctacaaattcacactat

SEQ ID NO: 981754 - DNA, 25 bp, Mus musculus
tttttcccctactaattcacactat

SEQ ID NO: 981755 - DNA, 25 bp, Mus musculus
tttttcccctatcgcttgttaaatg

SEQ ID NO: 981756 - DNA, 25 bp, Mus musculus
tttttcccctatggcttgttaaatg

SEQ ID NO: 981757 - DNA, 25 bp, Mus musculus
tttttcccctcgatcatatcttgaa

SEQ ID NO: 981758 - DNA, 25 bp, Mus musculus
tttttcccctcgttcatatcttgaa

SEQ ID NO: 981759 - DNA, 25 bp, Mus musculus
tttttccccttaaactggtgtgttg

SEQ ID NO: 981760 - DNA, 25 bp, Mus musculus
tttttccccttatactggtgtgttg

SEQ ID NO: 981761 - DNA, 25 bp, Mus musculus
tttttcccctttctgttagcacaca

SEQ ID NO: 981762 - DNA, 25 bp, Mus musculus
tttttcccctttgtgttagcacaca

SEQ ID NO: 981763 - DNA, 25 bp, Mus musculus
tttttcccgggaattagcacaggca

SEQ ID NO: 981764 - DNA, 25 bp, Mus musculus
tttttcccgggatttagcacaggca

SEQ ID NO: 981765 - DNA, 25 bp, Mus musculus
tttttccctcaaagtatctgtaaat

SEQ ID NO: 981766 - DNA, 25 bp, Mus musculus
tttttccctcaatgtatctgtaaat

SEQ ID NO: 981767 - DNA, 25 bp, Mus musculus
tttttccctcgaacacagtagctta

SEQ ID NO: 981768 - DNA, 25 bp, Mus musculus
tttttccctcgatcacagtagctta

SEQ ID NO: 981769 - DNA, 25 bp, Mus musculus
tttttccctgaaaactagctctgtg

SEQ ID NO: 981770 - DNA, 25 bp, Mus musculus
tttttccctgaatactagctctgtg

SEQ ID NO: 981771 - DNA, 25 bp, Mus musculus
tttttcccttatagacgcagagatt

SEQ ID NO: 981772 - DNA, 25 bp, Mus musculus
tttttcccttattgacgcagagatt

SEQ ID NO: 981773 - DNA, 25 bp, Mus musculus
tttttcccttcacgcagtggtgaca

SEQ ID NO: 981774 - DNA, 25 bp, Mus musculus
tttttcccttcaggcagtggtgaca

SEQ ID NO: 981775 - DNA, 25 bp, Mus musculus
tttttcccttctacagagcttgaat

SEQ ID NO: 981776 - DNA, 25 bp, Mus musculus
tttttcccttcttcagagcttgaat

SEQ ID NO: 981777 - DNA, 25 bp, Mus musculus
tttttccctttgcactggctcagag

SEQ ID NO: 981778 - DNA, 25 bp, Mus musculus
tttttccctttggactggctcagag

SEQ ID NO: 981779 - DNA, 25 bp, Mus musculus
tttttccgggagcagatcaccacct

SEQ ID NO: 981780 - DNA, 25 bp, Mus musculus
tttttccgggaggagatcaccacct

SEQ ID NO: 981781 - DNA, 25 bp, Mus musculus
tttttccggtgccactacttcaact

SEQ ID NO: 981782 - DNA, 25 bp, Mus musculus
tttttccggtgcgactacttcaact

SEQ ID NO: 981783 - DNA, 25 bp, Mus musculus
tttttcctaataaccacttaccagt

SEQ ID NO: 981784 - DNA, 25 bp, Mus musculus
tttttcctaatatccacttaccagt

SEQ ID NO: 981785 - DNA, 25 bp, Mus musculus
tttttcctacccaatttatgacagt

SEQ ID NO: 981786 - DNA, 25 bp, Mus musculus
tttttcctaccctatttatgacagt

SEQ ID NO: 981787 - DNA, 25 bp, Mus musculus
tttttcctagaacgtagtgtagcat

SEQ ID NO: 981788 - DNA, 25 bp, Mus musculus
tttttcctagaaggtagtgtagcat

SEQ ID NO: 981789 - DNA, 25 bp, Mus musculus
tttttcctagccagtactcaactga

SEQ ID NO: 981790 - DNA, 25 bp, Mus musculus
tttttcctagcctgtactcaactga

SEQ ID NO: 981791 - DNA, 25 bp, Mus musculus
tttttcctagcgaggctggctgcac

SEQ ID NO: 981792 - DNA, 25 bp, Mus musculus
tttttcctagcgtggctggctgcac

SEQ ID NO: 981793 - DNA, 25 bp, Mus musculus
tttttcctagttattctgcctgcca

SEQ ID NO: 981794 - DNA, 25 bp, Mus musculus
tttttcctagtttttctgcctgcca

SEQ ID NO: 981795 - DNA, 25 bp, Mus musculus
tttttcctatctcagtagcgtcact

SEQ ID NO: 981796 - DNA, 25 bp, Mus musculus
tttttcctatctgagtagcgtcact

SEQ ID NO: 981797 - DNA, 25 bp, Mus musculus
tttttcctatgaatactgtaagtgc

SEQ ID NO: 981798 - DNA, 25 bp, Mus musculus
tttttcctatgattactgtaagtgc

SEQ ID NO: 981799 - DNA, 25 bp, Mus musculus
tttttcctattcctcaagcatgcta

SEQ ID NO: 981800 - DNA, 25 bp, Mus musculus
tttttcctattcgtcaagcatgcta

SEQ ID NO: 981801 - DNA, 25 bp, Mus musculus
tttttcctcagcctggtaaggtctg

SEQ ID NO: 981802 - DNA, 25 bp, Mus musculus
tttttcctcagcgtggtaaggtctg

SEQ ID NO: 981803 - DNA, 25 bp, Mus musculus
tttttcctcagtccggacatttggg

SEQ ID NO: 981804 - DNA, 25 bp, Mus musculus
tttttcctcagtgcggacatttggg

SEQ ID NO: 981805 - DNA, 25 bp, Mus musculus
tttttcctcataaaatagtcactga

SEQ ID NO: 981806 - DNA, 25 bp, Mus musculus
tttttcctcatataatagtcactga

SEQ ID NO: 981807 - DNA, 25 bp, Mus musculus
tttttcctcctgaaagttggtgttg

SEQ ID NO: 981808 - DNA, 25 bp, Mus musculus
tttttcctcctgcatactcttgatt

SEQ ID NO: 981809 - DNA, 25 bp, Mus musculus
tttttcctcctggatactcttgatt

SEQ ID NO: 981810 - DNA, 25 bp, Mus musculus
tttttcctcctgtaagttggtgttg

SEQ ID NO: 981811 - DNA, 25 bp, Mus musculus
tttttcctccttactcgattgagat

SEQ ID NO: 981812 - DNA, 25 bp, Mus musculus
tttttcctcctttctcgattgagat

SEQ ID NO: 981813 - DNA, 25 bp, Mus musculus
tttttcctcgtgaaacattggtgaa

SEQ ID NO: 981814 - DNA, 25 bp, Mus musculus
tttttcctcgtgtaacattggtgaa

SEQ ID NO: 981815 - DNA, 25 bp, Mus musculus
tttttcctctagcagtatacagttg

SEQ ID NO: 981816 - DNA, 25 bp, Mus musculus
tttttcctctaggagtatacagttg

SEQ ID NO: 981817 - DNA, 25 bp, Mus musculus
tttttcctctccagtttagagttag

SEQ ID NO: 981818 - DNA, 25 bp, Mus musculus
tttttcctctcctgtttagagttag

SEQ ID NO: 981819 - DNA, 25 bp, Mus musculus
tttttcctctctagatttctccctt

SEQ ID NO: 981820 - DNA, 25 bp, Mus musculus
tttttcctctctccatgtaaacatt

SEQ ID NO: 981821 - DNA, 25 bp, Mus musculus
tttttcctctctgcatgtaaacatt

SEQ ID NO: 981822 - DNA, 25 bp, Mus musculus
tttttcctctcttgatttctccctt

SEQ ID NO: 981823 - DNA, 25 bp, Mus musculus
tttttcctctgtccgaatgagcatg

SEQ ID NO: 981824 - DNA, 25 bp, Mus musculus
tttttcctctgtgcgaatgagcatg

SEQ ID NO: 981825 - DNA, 25 bp, Mus musculus
tttttcctcttcaacttgttagaat

SEQ ID NO: 981826 - DNA, 25 bp, Mus musculus
tttttcctcttctacttgttagaat

SEQ ID NO: 981827 - DNA, 25 bp, Mus musculus
tttttcctgaataactagacattca

SEQ ID NO: 981828 - DNA, 25 bp, Mus musculus
tttttcctgaattactagacattca

SEQ ID NO: 981829 - DNA, 25 bp, Mus musculus
tttttcctgaggatgcatagcttat

SEQ ID NO: 981830 - DNA, 25 bp, Mus musculus
tttttcctgaggttgcatagcttat

SEQ ID NO: 981831 - DNA, 25 bp, Mus musculus
tttttcctgcctcactgggagagag

SEQ ID NO: 981832 - DNA, 25 bp, Mus musculus
tttttcctgcctgactgggagagag

SEQ ID NO: 981833 - DNA, 25 bp, Mus musculus
tttttcctgctcaacttttagagag

SEQ ID NO: 981834 - DNA, 25 bp, Mus musculus
tttttcctgctcacaatgagtggcc

SEQ ID NO: 981835 - DNA, 25 bp, Mus musculus
tttttcctgctctacttttagagag

SEQ ID NO: 981836 - DNA, 25 bp, Mus musculus
tttttcctgctctcaatgagtggcc

SEQ ID NO: 981837 - DNA, 25 bp, Mus musculus
tttttcctggccacactaaatgtgt

SEQ ID NO: 981838 - DNA, 25 bp, Mus musculus
tttttcctggcctcactaaatgtgt

SEQ ID NO: 981839 - DNA, 25 bp, Mus musculus
tttttcctggtcaactaaactactg

SEQ ID NO: 981840 - DNA, 25 bp, Mus musculus
tttttcctggtctactaaactactg

SEQ ID NO: 981841 - DNA, 25 bp, Mus musculus
tttttcctgtacaaaatgcctccta

SEQ ID NO: 981842 - DNA, 25 bp, Mus musculus
tttttcctgtactaaatgcctccta

SEQ ID NO: 981843 - DNA, 25 bp, Mus musculus
tttttcctgtctctggctatatcaa

SEQ ID NO: 981844 - DNA, 25 bp, Mus musculus
tttttcctgtctgtggctatatcaa

SEQ ID NO: 981845 - DNA, 25 bp, Mus musculus
tttttcctgttaatcactttcaaat

SEQ ID NO: 981846 - DNA, 25 bp, Mus musculus
tttttcctgttattcactttcaaat

SEQ ID NO: 981847 - DNA, 25 bp, Mus musculus
tttttcctgttcaactacctcttga

SEQ ID NO: 981848 - DNA, 25 bp, Mus musculus
tttttcctgttctactacctcttga

SEQ ID NO: 981849 - DNA, 25 bp, Mus musculus
tttttccttcacatattgctgaaac

SEQ ID NO: 981850 - DNA, 25 bp, Mus musculus
tttttccttcacttattgctgaaac

SEQ ID NO: 981851 - DNA, 25 bp, Mus musculus
tttttccttccaacacttcttgatt

SEQ ID NO: 981852 - DNA, 25 bp, Mus musculus
tttttccttccatcacttcttgatt

SEQ ID NO: 981853 - DNA, 25 bp, Mus musculus
tttttccttcctactgacattagaa

SEQ ID NO: 981854 - DNA, 25 bp, Mus musculus
tttttccttcctagcatttaccaag

SEQ ID NO: 981855 - DNA, 25 bp, Mus musculus
tttttccttcctcgctttcctgaat

SEQ ID NO: 981856 - DNA, 25 bp, Mus musculus
tttttccttcctggctttcctgaat

SEQ ID NO: 981857 - DNA, 25 bp, Mus musculus
tttttccttccttctgacattagaa

SEQ ID NO: 981858 - DNA, 25 bp, Mus musculus
tttttccttccttgcatttaccaag

SEQ ID NO: 981859 - DNA, 25 bp, Mus musculus
tttttccttcttcttgctgcattaa

SEQ ID NO: 981860 - DNA, 25 bp, Mus musculus
tttttccttcttgttgctgcattaa

SEQ ID NO: 981861 - DNA, 25 bp, Mus musculus
tttttccttgatagttaattgcaac

SEQ ID NO: 981862 - DNA, 25 bp, Mus musculus
tttttccttgattgttaattgcaac

SEQ ID NO: 981863 - DNA, 25 bp, Mus musculus
tttttccttggacgccatgatttga

SEQ ID NO: 981864 - DNA, 25 bp, Mus musculus
tttttccttggaggccatgatttga

SEQ ID NO: 981865 - DNA, 25 bp, Mus musculus
tttttccttggcagcgaatgtggcg

SEQ ID NO: 981866 - DNA, 25 bp, Mus musculus
tttttccttggctgcgaatgtggcg

SEQ ID NO: 981867 - DNA, 25 bp, Mus musculus
tttttccttgtcagaacgtggtcat

SEQ ID NO: 981868 - DNA, 25 bp, Mus musculus
tttttccttgtctgaacgtggtcat

SEQ ID NO: 981869 - DNA, 25 bp, Mus musculus
tttttcctttacaggacttgggcag

SEQ ID NO: 981870 - DNA, 25 bp, Mus musculus
tttttcctttactggacttgggcag

SEQ ID NO: 981871 - DNA, 25 bp, Mus musculus
tttttcctttatacgccagccatga

SEQ ID NO: 981872 - DNA, 25 bp, Mus musculus
tttttcctttatcttgtgccagtga

SEQ ID NO: 981873 - DNA, 25 bp, Mus musculus
tttttcctttatgttgtgccagtga

SEQ ID NO: 981874 - DNA, 25 bp, Mus musculus
tttttcctttattcgccagccatga

SEQ ID NO: 981875 - DNA, 25 bp, Mus musculus
tttttcctttggacatgaatgtgta

SEQ ID NO: 981876 - DNA, 25 bp, Mus musculus
tttttcctttggtcatgaatgtgta

SEQ ID NO: 981877 - DNA, 25 bp, Mus musculus
tttttcctttgtctgccatatactt

SEQ ID NO: 981878 - DNA, 25 bp, Mus musculus
tttttcctttgtgtgccatatactt

SEQ ID NO: 981879 - DNA, 25 bp, Mus musculus
tttttcgaaattacagtgacgtgtg

SEQ ID NO: 981880 - DNA, 25 bp, Mus musculus
tttttcgaaatttcagtgacgtgtg

SEQ ID NO: 981881 - DNA, 25 bp, Mus musculus
tttttcgagacacagatgcgcatta

SEQ ID NO: 981882 - DNA, 25 bp, Mus musculus
tttttcgagacagagatgcgcatta

SEQ ID NO: 981883 - DNA, 25 bp, Mus musculus
tttttcgatgaaatgcgggacccaa

SEQ ID NO: 981884 - DNA, 25 bp, Mus musculus
tttttcgatgaattgcgggacccaa

SEQ ID NO: 981885 - DNA, 25 bp, Mus musculus
tttttcgctattaaagttggatatt

SEQ ID NO: 981886 - DNA, 25 bp, Mus musculus
tttttcgctatttaagttggatatt

SEQ ID NO: 981887 - DNA, 25 bp, Mus musculus
tttttcggccatcctaagaccaaag

SEQ ID NO: 981888 - DNA, 25 bp, Mus musculus
tttttcggccatgctaagaccaaag

SEQ ID NO: 981889 - DNA, 25 bp, Mus musculus
tttttcggctgcctccgtatcaggg

SEQ ID NO: 981890 - DNA, 25 bp, Mus musculus
tttttcggctgcgtccgtatcaggg

SEQ ID NO: 981891 - DNA, 25 bp, Mus musculus
tttttcgtagataccttccttgcct

SEQ ID NO: 981892 - DNA, 25 bp, Mus musculus
tttttcgtagattccttccttgcct

SEQ ID NO: 981893 - DNA, 25 bp, Mus musculus
tttttcgtgtgtcatttccgcgtgc

SEQ ID NO: 981894 - DNA, 25 bp, Mus musculus
tttttcgtgtgtgatttccgcgtgc

SEQ ID NO: 981895 - DNA, 25 bp, Mus musculus
tttttctaaaaaagaccaactgctg

SEQ ID NO: 981896 - DNA, 25 bp, Mus musculus
tttttctaaaaatgaccaactgctg

SEQ ID NO: 981897 - DNA, 25 bp, Mus musculus
tttttctaaatccttgtcctctggc

SEQ ID NO: 981898 - DNA, 25 bp, Mus musculus
tttttctaaatcgttgtcctctggc

SEQ ID NO: 981899 - DNA, 25 bp, Mus musculus
tttttctaacgcctggactgagctg

SEQ ID NO: 981900 - DNA, 25 bp, Mus musculus
tttttctaacgcgtggactgagctg

SEQ ID NO: 981901 - DNA, 25 bp, Mus musculus
tttttctaattaaaccccgattcag

SEQ ID NO: 981902 - DNA, 25 bp, Mus musculus
tttttctaattataccccgattcag

SEQ ID NO: 981903 - DNA, 25 bp, Mus musculus
tttttctacaaacatggctccacat

SEQ ID NO: 981904 - DNA, 25 bp, Mus musculus
tttttctacaaagatggctccacat

SEQ ID NO: 981905 - DNA, 25 bp, Mus musculus
tttttctaccacacgcatagtcaaa

SEQ ID NO: 981906 - DNA, 25 bp, Mus musculus
tttttctaccactcgcatagtcaaa

SEQ ID NO: 981907 - DNA, 25 bp, Mus musculus
tttttctaccatctaaggaccaggg

SEQ ID NO: 981908 - DNA, 25 bp, Mus musculus
tttttctaccatgtaaggaccaggg

SEQ ID NO: 981909 - DNA, 25 bp, Mus musculus
tttttctacctccaattctgctgaa

SEQ ID NO: 981910 - DNA, 25 bp, Mus musculus
tttttctacctcgaattctgctgaa

SEQ ID NO: 981911 - DNA, 25 bp, Mus musculus
tttttctacgtaattgtgaccaaca

SEQ ID NO: 981912 - DNA, 25 bp, Mus musculus
tttttctacgtatttgtgaccaaca

SEQ ID NO: 981913 - DNA, 25 bp, Mus musculus
tttttctacttcacagatcccttct

SEQ ID NO: 981914 - DNA, 25 bp, Mus musculus
tttttctacttctcagatcccttct

SEQ ID NO: 981915 - DNA, 25 bp, Mus musculus
tttttctagctaattttcccatgat

SEQ ID NO: 981916 - DNA, 25 bp, Mus musculus
tttttctagctatttttcccatgat

SEQ ID NO: 981917 - DNA, 25 bp, Mus musculus
tttttctaggacactgtgcacctgt

SEQ ID NO: 981918 - DNA, 25 bp, Mus musculus
tttttctaggactctgtgcacctgt

SEQ ID NO: 981919 - DNA, 25 bp, Mus musculus
tttttctagtggcatgatgtaatgg

SEQ ID NO: 981920 - DNA, 25 bp, Mus musculus
tttttctagtgggatgatgtaatgg

SEQ ID NO: 981921 - DNA, 25 bp, Mus musculus
tttttctagtttcagttttggcact

SEQ ID NO: 981922 - DNA, 25 bp, Mus musculus
tttttctagtttgagttttggcact

SEQ ID NO: 981923 - DNA, 25 bp, Mus musculus
tttttctatcgtctctgctatgtca

SEQ ID NO: 981924 - DNA, 25 bp, Mus musculus
tttttctatcgtgtctgctatgtca

SEQ ID NO: 981925 - DNA, 25 bp, Mus musculus
tttttctatgttctctttctatcct

SEQ ID NO: 981926 - DNA, 25 bp, Mus musculus
tttttctatgttgtctttctatcct

SEQ ID NO: 981927 - DNA, 25 bp, Mus musculus
tttttctattccctactctgacttg

SEQ ID NO: 981928 - DNA, 25 bp, Mus musculus
tttttctattccgtactctgacttg

SEQ ID NO: 981929 - DNA, 25 bp, Mus musculus
tttttctcaactctgcctagggcaa

SEQ ID NO: 981930 - DNA, 25 bp, Mus musculus
tttttctcaactgtgcctagggcaa

SEQ ID NO: 981931 - DNA, 25 bp, Mus musculus
tttttctcacccagatcttaagttg

SEQ ID NO: 981932 - DNA, 25 bp, Mus musculus
tttttctcaccctgatcttaagttg

SEQ ID NO: 981933 - DNA, 25 bp, Mus musculus
tttttctcacgacgcagcaagctta

SEQ ID NO: 981934 - DNA, 25 bp, Mus musculus
tttttctcacgaggcagcaagctta

SEQ ID NO: 981935 - DNA, 25 bp, Mus musculus
tttttctccaacacgtcagagctgg

SEQ ID NO: 981936 - DNA, 25 bp, Mus musculus
tttttctccaactcgtcagagctgg

SEQ ID NO: 981937 - DNA, 25 bp, Mus musculus
tttttctccatcatgcccttggtta

SEQ ID NO: 981938 - DNA, 25 bp, Mus musculus
tttttctccatcttgcccttggtta

SEQ ID NO: 981939 - DNA, 25 bp, Mus musculus
tttttctccatgatatctacaccaa

SEQ ID NO: 981940 - DNA, 25 bp, Mus musculus
tttttctccatgttatctacaccaa

SEQ ID NO: 981941 - DNA, 25 bp, Mus musculus
tttttctccccaatggtccaccaga

SEQ ID NO: 981942 - DNA, 25 bp, Mus musculus
tttttctccccattggtccaccaga

SEQ ID NO: 981943 - DNA, 25 bp, Mus musculus
tttttctcccctcaattattaggca

SEQ ID NO: 981944 - DNA, 25 bp, Mus musculus
tttttctcccctgaattattaggca

SEQ ID NO: 981945 - DNA, 25 bp, Mus musculus
tttttctccctcattatcttacctg

SEQ ID NO: 981946 - DNA, 25 bp, Mus musculus
tttttctccctctttatcttacctg

SEQ ID NO: 981947 - DNA, 25 bp, Mus musculus
tttttctcccttcggcttgaggcca

SEQ ID NO: 981948 - DNA, 25 bp, Mus musculus
tttttctcccttgggcttgaggcca

SEQ ID NO: 981949 - DNA, 25 bp, Mus musculus
tttttctcctatcagcaatctcaag

SEQ ID NO: 981950 - DNA, 25 bp, Mus musculus
tttttctcctatgagcaatctcaag

SEQ ID NO: 981951 - DNA, 25 bp, Mus musculus
tttttctcctccatacaagtccata

SEQ ID NO: 981952 - DNA, 25 bp, Mus musculus
tttttctcctccttacaagtccata

SEQ ID NO: 981953 - DNA, 25 bp, Mus musculus
tttttctcctctctcatgacgaaaa

SEQ ID NO: 981954 - DNA, 25 bp, Mus musculus
tttttctcctctgtcatgacgaaaa

SEQ ID NO: 981955 - DNA, 25 bp, Mus musculus
tttttctcctgtctattgcttttaa

SEQ ID NO: 981956 - DNA, 25 bp, Mus musculus
tttttctcctgtgtattgcttttaa

SEQ ID NO: 981957 - DNA, 25 bp, Mus musculus
tttttctccttcatgactcatcgat

SEQ ID NO: 981958 - DNA, 25 bp, Mus musculus
tttttctccttcttgactcatcgat

SEQ ID NO: 981959 - DNA, 25 bp, Mus musculus
tttttctccttgcttatgcagtgga

SEQ ID NO: 981960 - DNA, 25 bp, Mus musculus
tttttctccttggttatgcagtgga

SEQ ID NO: 981961 - DNA, 25 bp, Mus musculus
tttttctctcatctctcattgtctc

SEQ ID NO: 981962 - DNA, 25 bp, Mus musculus
tttttctctcatgtctcattgtctc

SEQ ID NO: 981963 - DNA, 25 bp, Mus musculus
tttttctctcctccagtctatgtat

SEQ ID NO: 981964 - DNA, 25 bp, Mus musculus
tttttctctcctgcagtctatgtat

SEQ ID NO: 981965 - DNA, 25 bp, Mus musculus
tttttctctctaccctggatctcaa

SEQ ID NO: 981966 - DNA, 25 bp, Mus musculus
tttttctctctagcctggatctcaa

SEQ ID NO: 981967 - DNA, 25 bp, Mus musculus
tttttctctctcaaagtggtatgca

SEQ ID NO: 981968 - DNA, 25 bp, Mus musculus
tttttctctctctaagtggtatgca

SEQ ID NO: 981969 - DNA, 25 bp, Mus musculus
tttttctctctgaggctctcttgct

SEQ ID NO: 981970 - DNA, 25 bp, Mus musculus
tttttctctctgtggctctcttgct

SEQ ID NO: 981971 - DNA, 25 bp, Mus musculus
tttttctctcttagttgcagatttg

SEQ ID NO: 981972 - DNA, 25 bp, Mus musculus
tttttctctcttcagtaatatccct

SEQ ID NO: 981973 - DNA, 25 bp, Mus musculus
tttttctctcttgagtaatatccct

SEQ ID NO: 981974 - DNA, 25 bp, Mus musculus
tttttctctctttgttgcagatttg

SEQ ID NO: 981975 - DNA, 25 bp, Mus musculus
tttttctctgtacacccaagcctag

SEQ ID NO: 981976 - DNA, 25 bp, Mus musculus
tttttctctgtagacccaagcctag

SEQ ID NO: 981977 - DNA, 25 bp, Mus musculus
tttttctctgtcattgaactccaca

SEQ ID NO: 981978 - DNA, 25 bp, Mus musculus
tttttctctgtctttgaactccaca

SEQ ID NO: 981979 - DNA, 25 bp, Mus musculus
tttttctctgtgaatccgtgggtct

SEQ ID NO: 981980 - DNA, 25 bp, Mus musculus
tttttctctgtgtatccgtgggtct

SEQ ID NO: 981981 - DNA, 25 bp, Mus musculus
tttttctgaatcagctccctaatgc

SEQ ID NO: 981982 - DNA, 25 bp, Mus musculus
tttttctgaatctgctccctaatgc

SEQ ID NO: 981983 - DNA, 25 bp, Mus musculus
tttttctgacagaacacagtccaag

SEQ ID NO: 981984 - DNA, 25 bp, Mus musculus
tttttctgacagtacacagtccaag

SEQ ID NO: 981985 - DNA, 25 bp, Mus musculus
tttttctgactccacttgctgtttt

SEQ ID NO: 981986 - DNA, 25 bp, Mus musculus
tttttctgactcgacttgctgtttt

SEQ ID NO: 981987 - DNA, 25 bp, Mus musculus
tttttctgagccactaagacaaatg

SEQ ID NO: 981988 - DNA, 25 bp, Mus musculus
tttttctgagcctctaagacaaatg

SEQ ID NO: 981989 - DNA, 25 bp, Mus musculus
tttttctgagttcgctcagccttca

SEQ ID NO: 981990 - DNA, 25 bp, Mus musculus
tttttctgagttggctcagccttca

SEQ ID NO: 981991 - DNA, 25 bp, Mus musculus
tttttctgcctcattcactagattg

SEQ ID NO: 981992 - DNA, 25 bp, Mus musculus
tttttctgcctctttcactagattg

SEQ ID NO: 981993 - DNA, 25 bp, Mus musculus
tttttctgcctgatataccctcaaa

SEQ ID NO: 981994 - DNA, 25 bp, Mus musculus
tttttctgcctgttataccctcaaa

SEQ ID NO: 981995 - DNA, 25 bp, Mus musculus
tttttctgctcacaacctgcttggg

SEQ ID NO: 981996 - DNA, 25 bp, Mus musculus
tttttctgctcagaacctgcttggg

SEQ ID NO: 981997 - DNA, 25 bp, Mus musculus
tttttctgcttgaggcatacgtaga

SEQ ID NO: 981998 - DNA, 25 bp, Mus musculus
tttttctgcttgtggcatacgtaga

SEQ ID NO: 981999 - DNA, 25 bp, Mus musculus
tttttctggacaaccttgtaggtag

SEQ ID NO: 982000 - DNA, 25 bp, Mus musculus
tttttctggacatccttgtaggtag

SEQ ID NO: 982001 - DNA, 25 bp, Mus musculus
tttttctggcagacggaggtggaac

SEQ ID NO: 982002 - DNA, 25 bp, Mus musculus
tttttctggcagtcggaggtggaac

SEQ ID NO: 982003 - DNA, 25 bp, Mus musculus
tttttctggcctccgatggtgacat

SEQ ID NO: 982004 - DNA, 25 bp, Mus musculus
tttttctggcctgcgatggtgacat

SEQ ID NO: 982005 - DNA, 25 bp, Mus musculus
tttttctgtaacactacttgttctt

SEQ ID NO: 982006 - DNA, 25 bp, Mus musculus
tttttctgtaactctacttgttctt

SEQ ID NO: 982007 - DNA, 25 bp, Mus musculus
tttttctgtatgagatctgcctctt

SEQ ID NO: 982008 - DNA, 25 bp, Mus musculus
tttttctgtatgtgatctgcctctt

SEQ ID NO: 982009 - DNA, 25 bp, Mus musculus
tttttctgtattcggtatgcggcac

SEQ ID NO: 982010 - DNA, 25 bp, Mus musculus
tttttctgtattgggtatgcggcac

SEQ ID NO: 982011 - DNA, 25 bp, Mus musculus
tttttctgtgcacaatcctggtatc

SEQ ID NO: 982012 - DNA, 25 bp, Mus musculus
tttttctgtgcagaatcctggtatc

SEQ ID NO: 982013 - DNA, 25 bp, Mus musculus
tttttctgtgccacactcctgtaag

SEQ ID NO: 982014 - DNA, 25 bp, Mus musculus
tttttctgtgcctcactcctgtaag

SEQ ID NO: 982015 - DNA, 25 bp, Mus musculus
tttttctgtgggaacgaggtgaata

SEQ ID NO: 982016 - DNA, 25 bp, Mus musculus
tttttctgtgggtacgaggtgaata

SEQ ID NO: 982017 - DNA, 25 bp, Mus musculus
tttttctgttttcctggatttctct

SEQ ID NO: 982018 - DNA, 25 bp, Mus musculus
tttttctgttttgctggatttctct

SEQ ID NO: 982019 - DNA, 25 bp, Mus musculus
tttttcttaatcagggccaatgtgt

SEQ ID NO: 982020 - DNA, 25 bp, Mus musculus
tttttcttaatctgggccaatgtgt

SEQ ID NO: 982021 - DNA, 25 bp, Mus musculus
tttttcttaattcctccgcatttag

SEQ ID NO: 982022 - DNA, 25 bp, Mus musculus
tttttcttaattgctccgcatttag

SEQ ID NO: 982023 - DNA, 25 bp, Mus musculus
tttttcttagaaccgtgggtcttgg

SEQ ID NO: 982024 - DNA, 25 bp, Mus musculus
tttttcttagaactgcttccgtgcc

SEQ ID NO: 982025 - DNA, 25 bp, Mus musculus
tttttcttagaagcgtgggtcttgg

SEQ ID NO: 982026 - DNA, 25 bp, Mus musculus
tttttcttagaagtgcttccgtgcc

SEQ ID NO: 982027 - DNA, 25 bp, Mus musculus
tttttcttagacaccatccactgga

SEQ ID NO: 982028 - DNA, 25 bp, Mus musculus
tttttcttagactccatccactgga

SEQ ID NO: 982029 - DNA, 25 bp, Mus musculus
tttttcttagctctggccaggcagt

SEQ ID NO: 982030 - DNA, 25 bp, Mus musculus
tttttcttagctgtggccaggcagt

SEQ ID NO: 982031 - DNA, 25 bp, Mus musculus
tttttcttatctatgcaatgctcct

SEQ ID NO: 982032 - DNA, 25 bp, Mus musculus
tttttcttatctcgactgccttgtc

SEQ ID NO: 982033 - DNA, 25 bp, Mus musculus
tttttcttatctggactgccttgtc

SEQ ID NO: 982034 - DNA, 25 bp, Mus musculus
tttttcttatctttgcaatgctcct

SEQ ID NO: 982035 - DNA, 25 bp, Mus musculus
tttttcttcaacataagcaatacag

SEQ ID NO: 982036 - DNA, 25 bp, Mus musculus
tttttcttcaacttaagcaatacag

SEQ ID NO: 982037 - DNA, 25 bp, Mus musculus
tttttcttcacaaaattagtttcat

SEQ ID NO: 982038 - DNA, 25 bp, Mus musculus
tttttcttcacataattagtttcat

SEQ ID NO: 982039 - DNA, 25 bp, Mus musculus
tttttcttcacgcgcaggacccact

SEQ ID NO: 982040 - DNA, 25 bp, Mus musculus
tttttcttcacgggcaggacccact

SEQ ID NO: 982041 - DNA, 25 bp, Mus musculus
tttttcttcataaggctctagtttg

SEQ ID NO: 982042 - DNA, 25 bp, Mus musculus
tttttcttcatatggctctagtttg

SEQ ID NO: 982043 - DNA, 25 bp, Mus musculus
tttttcttccagaaagactccagac

SEQ ID NO: 982044 - DNA, 25 bp, Mus musculus
tttttcttccagtaagactccagac

SEQ ID NO: 982045 - DNA, 25 bp, Mus musculus
tttttcttcccacgctaaattattg

SEQ ID NO: 982046 - DNA, 25 bp, Mus musculus
tttttcttcccaggctaaattattg

SEQ ID NO: 982047 - DNA, 25 bp, Mus musculus
tttttcttccctaccactatgaact

SEQ ID NO: 982048 - DNA, 25 bp, Mus musculus
tttttcttcccttccactatgaact

SEQ ID NO: 982049 - DNA, 25 bp, Mus musculus
tttttcttcctcaaagctactgtta

SEQ ID NO: 982050 - DNA, 25 bp, Mus musculus
tttttcttcctctaagctactgtta

SEQ ID NO: 982051 - DNA, 25 bp, Mus musculus
tttttcttccttcccaactgttagt

SEQ ID NO: 982052 - DNA, 25 bp, Mus musculus
tttttcttccttgccaactgttagt

SEQ ID NO: 982053 - DNA, 25 bp, Mus musculus
tttttcttcgagaaggcaaccctgg

SEQ ID NO: 982054 - DNA, 25 bp, Mus musculus
tttttcttcgagtaggcaaccctgg

SEQ ID NO: 982055 - DNA, 25 bp, Mus musculus
tttttcttcgtaatgatcttctcac

SEQ ID NO: 982056 - DNA, 25 bp, Mus musculus
tttttcttcgtattgatcttctcac

SEQ ID NO: 982057 - DNA, 25 bp, Mus musculus
tttttcttcttcattaggctgaaca

SEQ ID NO: 982058 - DNA, 25 bp, Mus musculus
tttttcttcttctttaggctgaaca

SEQ ID NO: 982059 - DNA, 25 bp, Mus musculus
tttttcttctttcctatctacatag

SEQ ID NO: 982060 - DNA, 25 bp, Mus musculus
tttttcttctttgctatctacatag

SEQ ID NO: 982061 - DNA, 25 bp, Mus musculus
tttttcttgaccagagtgccctggt

SEQ ID NO: 982062 - DNA, 25 bp, Mus musculus
tttttcttgacctgagtgccctggt

SEQ ID NO: 982063 - DNA, 25 bp, Mus musculus
tttttcttggatcctcgtctctgga

SEQ ID NO: 982064 - DNA, 25 bp, Mus musculus
tttttcttggatgctcgtctctgga

SEQ ID NO: 982065 - DNA, 25 bp, Mus musculus
tttttcttgttgcacagtcctaatt

SEQ ID NO: 982066 - DNA, 25 bp, Mus musculus
tttttcttgttggacagtcctaatt

SEQ ID NO: 982067 - DNA, 25 bp, Mus musculus
tttttctttaagctaagccagacat

SEQ ID NO: 982068 - DNA, 25 bp, Mus musculus
tttttctttaaggtaagccagacat

SEQ ID NO: 982069 - DNA, 25 bp, Mus musculus
tttttctttaatatgtcctgcctgc

SEQ ID NO: 982070 - DNA, 25 bp, Mus musculus
tttttctttaatttgtcctgcctgc

SEQ ID NO: 982071 - DNA, 25 bp, Mus musculus
tttttctttactcccttgtcaagat

SEQ ID NO: 982072 - DNA, 25 bp, Mus musculus
tttttctttactgccttgtcaagat

SEQ ID NO: 982073 - DNA, 25 bp, Mus musculus
tttttctttaggcacatgacctttg

SEQ ID NO: 982074 - DNA, 25 bp, Mus musculus
tttttctttagggacatgacctttg

SEQ ID NO: 982075 - DNA, 25 bp, Mus musculus
tttttctttcacatggttatgcaaa

SEQ ID NO: 982076 - DNA, 25 bp, Mus musculus
tttttctttcacttggttatgcaaa

SEQ ID NO: 982077 - DNA, 25 bp, Mus musculus
tttttctttcttcgttctgcaaaca

SEQ ID NO: 982078 - DNA, 25 bp, Mus musculus
tttttctttcttggttctgcaaaca

SEQ ID NO: 982079 - DNA, 25 bp, Mus musculus
tttttctttgacatctctttataga

SEQ ID NO: 982080 - DNA, 25 bp, Mus musculus
tttttctttgacttctctttataga

SEQ ID NO: 982081 - DNA, 25 bp, Mus musculus
tttttctttgcactgtgttaacggg

SEQ ID NO: 982082 - DNA, 25 bp, Mus musculus
tttttctttgcagtgtgttaacggg

SEQ ID NO: 982083 - DNA, 25 bp, Mus musculus
tttttctttgccatctgtcagtcag

SEQ ID NO: 982084 - DNA, 25 bp, Mus musculus
tttttctttgccatctttttgctca

SEQ ID NO: 982085 - DNA, 25 bp, Mus musculus
tttttctttgccttctgtcagtcag

SEQ ID NO: 982086 - DNA, 25 bp, Mus musculus
tttttctttgccttctttttgctca

SEQ ID NO: 982087 - DNA, 25 bp, Mus musculus
tttttcttttcaccagatgtgacta

SEQ ID NO: 982088 - DNA, 25 bp, Mus musculus
tttttcttttcagcagatgtgacta

SEQ ID NO: 982089 - DNA, 25 bp, Mus musculus
tttttctttttaacaaatgacactt

SEQ ID NO: 982090 - DNA, 25 bp, Mus musculus
tttttctttttatcaaatgacactt

SEQ ID NO: 982091 - DNA, 25 bp, Mus musculus
tttttctttttgctgaagtaccact

SEQ ID NO: 982092 - DNA, 25 bp, Mus musculus
tttttctttttggtgaagtaccact

SEQ ID NO: 982093 - DNA, 25 bp, Mus musculus
tttttgaaaaatacagtgatcctgc

SEQ ID NO: 982094 - DNA, 25 bp, Mus musculus
tttttgaaaaattcagtgatcctgc

SEQ ID NO: 982095 - DNA, 25 bp, Mus musculus
tttttgaactgtactttgctgagtt

SEQ ID NO: 982096 - DNA, 25 bp, Mus musculus
tttttgaactgttctttgctgagtt

SEQ ID NO: 982097 - DNA, 25 bp, Mus musculus
tttttgaagcttccagagccgccta

SEQ ID NO: 982098 - DNA, 25 bp, Mus musculus
tttttgaagcttgcagagccgccta

SEQ ID NO: 982099 - DNA, 25 bp, Mus musculus
tttttgaatactatgcgggctggct

SEQ ID NO: 982100 - DNA, 25 bp, Mus musculus
tttttgaatactttgcgggctggct

SEQ ID NO: 982101 - DNA, 25 bp, Mus musculus
tttttgaatattagctaaagcctag

SEQ ID NO: 982102 - DNA, 25 bp, Mus musculus
tttttgaatatttgctaaagcctag

SEQ ID NO: 982103 - DNA, 25 bp, Mus musculus
tttttgacacatctgtcaacccacc

SEQ ID NO: 982104 - DNA, 25 bp, Mus musculus
tttttgacacatgtgtcaacccacc

SEQ ID NO: 982105 - DNA, 25 bp, Mus musculus
tttttgacagaccagccacaccatg

SEQ ID NO: 982106 - DNA, 25 bp, Mus musculus
tttttgacagacgagccacaccatg

SEQ ID NO: 982107 - DNA, 25 bp, Mus musculus
tttttgaccgtcaccattaaggaga

SEQ ID NO: 982108 - DNA, 25 bp, Mus musculus
tttttgaccgtctccattaaggaga

SEQ ID NO: 982109 - DNA, 25 bp, Mus musculus
tttttgacgactattgcagcaccac

SEQ ID NO: 982110 - DNA, 25 bp, Mus musculus
tttttgacgacttttgcagcaccac

SEQ ID NO: 982111 - DNA, 25 bp, Mus musculus
tttttgactacacaatctatccgat

SEQ ID NO: 982112 - DNA, 25 bp, Mus musculus
tttttgactacagaatctatccgat

SEQ ID NO: 982113 - DNA, 25 bp, Mus musculus
tttttgagaattagctctacctagc

SEQ ID NO: 982114 - DNA, 25 bp, Mus musculus
tttttgagaatttgctctacctagc

SEQ ID NO: 982115 - DNA, 25 bp, Mus musculus
tttttgagacaaatccatcttagat

SEQ ID NO: 982116 - DNA, 25 bp, Mus musculus
tttttgagacaattccatcttagat

SEQ ID NO: 982117 - DNA, 25 bp, Mus musculus
tttttgagacatacgggctaccttc

SEQ ID NO: 982118 - DNA, 25 bp, Mus musculus
tttttgagacattcgggctaccttc

SEQ ID NO: 982119 - DNA, 25 bp, Mus musculus
tttttgagaccaagtgccgagcctc

SEQ ID NO: 982120 - DNA, 25 bp, Mus musculus
tttttgagaccatgtgccgagcctc

SEQ ID NO: 982121 - DNA, 25 bp, Mus musculus
tttttgagcgggacggacagcccta

SEQ ID NO: 982122 - DNA, 25 bp, Mus musculus
tttttgagcgggtcggacagcccta

SEQ ID NO: 982123 - DNA, 25 bp, Mus musculus
tttttgagctcaccaagtgcgggtg

SEQ ID NO: 982124 - DNA, 25 bp, Mus musculus
tttttgagctcagcaagtgcgggtg

SEQ ID NO: 982125 - DNA, 25 bp, Mus musculus
tttttgaggccgattctgcacagat

SEQ ID NO: 982126 - DNA, 25 bp, Mus musculus
tttttgaggccgtttctgcacagat

SEQ ID NO: 982127 - DNA, 25 bp, Mus musculus
tttttgaggctgactcatgtttggc

SEQ ID NO: 982128 - DNA, 25 bp, Mus musculus
tttttgaggctgtctcatgtttggc

SEQ ID NO: 982129 - DNA, 25 bp, Mus musculus
tttttgagttcacggcctgcctagt

SEQ ID NO: 982130 - DNA, 25 bp, Mus musculus
tttttgagttcagggcctgcctagt

SEQ ID NO: 982131 - DNA, 25 bp, Mus musculus
tttttgataacaccactgctgctgc

SEQ ID NO: 982132 - DNA, 25 bp, Mus musculus
tttttgataacagcactgctgctgc

SEQ ID NO: 982133 - DNA, 25 bp, Mus musculus
tttttgatactaaatcccctaccca

SEQ ID NO: 982134 - DNA, 25 bp, Mus musculus
tttttgatactatatcccctaccca

SEQ ID NO: 982135 - DNA, 25 bp, Mus musculus
tttttgatagtacgagacgcccagt

SEQ ID NO: 982136 - DNA, 25 bp, Mus musculus
tttttgatagtaggagacgcccagt

SEQ ID NO: 982137 - DNA, 25 bp, Mus musculus
tttttgatctttcggacctatatgg

SEQ ID NO: 982138 - DNA, 25 bp, Mus musculus
tttttgatctttgggacctatatgg

SEQ ID NO: 982139 - DNA, 25 bp, Mus musculus
tttttgattaataccctcctgtcac

SEQ ID NO: 982140 - DNA, 25 bp, Mus musculus
tttttgattaattccctcctgtcac

SEQ ID NO: 982141 - DNA, 25 bp, Mus musculus
tttttgattctgatgccatttgtgt

SEQ ID NO: 982142 - DNA, 25 bp, Mus musculus
tttttgattctgttgccatttgtgt

SEQ ID NO: 982143 - DNA, 25 bp, Mus musculus
tttttgatttccaaggagacccagc

SEQ ID NO: 982144 - DNA, 25 bp, Mus musculus
tttttgatttccattgtactgtttg

SEQ ID NO: 982145 - DNA, 25 bp, Mus musculus
tttttgatttcctaggagacccagc

SEQ ID NO: 982146 - DNA, 25 bp, Mus musculus
tttttgatttcctttgtactgtttg

SEQ ID NO: 982147 - DNA, 25 bp, Mus musculus
tttttgatttgtcctgtgtggctgg

SEQ ID NO: 982148 - DNA, 25 bp, Mus musculus
tttttgatttgtgctgtgtggctgg

SEQ ID NO: 982149 - DNA, 25 bp, Mus musculus
tttttgattttcaccattgcctctc

SEQ ID NO: 982150 - DNA, 25 bp, Mus musculus
tttttgattttctccattgcctctc

SEQ ID NO: 982151 - DNA, 25 bp, Mus musculus
tttttgcaaagcagcattagcgctg

SEQ ID NO: 982152 - DNA, 25 bp, Mus musculus
tttttgcaaagctgcattagcgctg

SEQ ID NO: 982153 - DNA, 25 bp, Mus musculus
tttttgcaacgtaggtgtcctgcat

SEQ ID NO: 982154 - DNA, 25 bp, Mus musculus
tttttgcaacgttggtgtcctgcat

SEQ ID NO: 982155 - DNA, 25 bp, Mus musculus
tttttgcacataatttggctggtat

SEQ ID NO: 982156 - DNA, 25 bp, Mus musculus
tttttgcacatattttggctggtat

SEQ ID NO: 982157 - DNA, 25 bp, Mus musculus
tttttgcacgttcacgagcattcac

SEQ ID NO: 982158 - DNA, 25 bp, Mus musculus
tttttgcacgttgacgagcattcac

SEQ ID NO: 982159 - DNA, 25 bp, Mus musculus
tttttgcagctcattcctggcacag

SEQ ID NO: 982160 - DNA, 25 bp, Mus musculus
tttttgcagctctttcctggcacag

SEQ ID NO: 982161 - DNA, 25 bp, Mus musculus
tttttgcagggtatgcacaggcccc

SEQ ID NO: 982162 - DNA, 25 bp, Mus musculus
tttttgcagggtttgcacaggcccc

SEQ ID NO: 982163 - DNA, 25 bp, Mus musculus
tttttgcatggacacagattagctg

SEQ ID NO: 982164 - DNA, 25 bp, Mus musculus
tttttgcatggagacagattagctg

SEQ ID NO: 982165 - DNA, 25 bp, Mus musculus
tttttgcatgtgagtacacatgatt

SEQ ID NO: 982166 - DNA, 25 bp, Mus musculus
tttttgcatgtgtgtacacatgatt

SEQ ID NO: 982167 - DNA, 25 bp, Mus musculus
tttttgccaaggacctgaagaccag

SEQ ID NO: 982168 - DNA, 25 bp, Mus musculus
tttttgccaaggtcctgaagaccag

SEQ ID NO: 982169 - DNA, 25 bp, Mus musculus
tttttgccacctatcttcctgaata

SEQ ID NO: 982170 - DNA, 25 bp, Mus musculus
tttttgccacctttcttcctgaata

SEQ ID NO: 982171 - DNA, 25 bp, Mus musculus
tttttgccattaagagtattctcct

SEQ ID NO: 982172 - DNA, 25 bp, Mus musculus
tttttgccattatgagtattctcct

SEQ ID NO: 982173 - DNA, 25 bp, Mus musculus
tttttgcccagccagataaacagga

SEQ ID NO: 982174 - DNA, 25 bp, Mus musculus
tttttgcccagcgagataaacagga

SEQ ID NO: 982175 - DNA, 25 bp, Mus musculus
tttttgccgcgcacgtttaatagaa

SEQ ID NO: 982176 - DNA, 25 bp, Mus musculus
tttttgccgcgctcgtttaatagaa

SEQ ID NO: 982177 - DNA, 25 bp, Mus musculus
tttttgccgctgagtcagatggaca

SEQ ID NO: 982178 - DNA, 25 bp, Mus musculus
tttttgccgctgtgtcagatggaca

SEQ ID NO: 982179 - DNA, 25 bp, Mus musculus
tttttgccgtcgcagtaaagtttgc

SEQ ID NO: 982180 - DNA, 25 bp, Mus musculus
tttttgccgtcggagtaaagtttgc

SEQ ID NO: 982181 - DNA, 25 bp, Mus musculus
tttttgccgtctctgcgatgtcatt

SEQ ID NO: 982182 - DNA, 25 bp, Mus musculus
tttttgccgtctgtgcgatgtcatt

SEQ ID NO: 982183 - DNA, 25 bp, Mus musculus
tttttgcctcagctccgtggttcct

SEQ ID NO: 982184 - DNA, 25 bp, Mus musculus
tttttgcctcaggtccgtggttcct

SEQ ID NO: 982185 - DNA, 25 bp, Mus musculus
tttttgcctcataccatatttgtag

SEQ ID NO: 982186 - DNA, 25 bp, Mus musculus
tttttgcctcattccatatttgtag

SEQ ID NO: 982187 - DNA, 25 bp, Mus musculus
tttttgccttgccaagtctaacaac

SEQ ID NO: 982188 - DNA, 25 bp, Mus musculus
tttttgccttgcgaagtctaacaac

SEQ ID NO: 982189 - DNA, 25 bp, Mus musculus
tttttgctatccaatgacgtgataa

SEQ ID NO: 982190 - DNA, 25 bp, Mus musculus
tttttgctatcctatgacgtgataa

SEQ ID NO: 982191 - DNA, 25 bp, Mus musculus
tttttgctatggaaaaaacacagca

SEQ ID NO: 982192 - DNA, 25 bp, Mus musculus
tttttgctatggtaaaaacacagca

SEQ ID NO: 982193 - DNA, 25 bp, Mus musculus
tttttgctcactaccccactgttgc

SEQ ID NO: 982194 - DNA, 25 bp, Mus musculus
tttttgctcacttccccactgttgc

SEQ ID NO: 982195 - DNA, 25 bp, Mus musculus
tttttgctcatccacacatgtgctg

SEQ ID NO: 982196 - DNA, 25 bp, Mus musculus
tttttgctcatcgacacatgtgctg

SEQ ID NO: 982197 - DNA, 25 bp, Mus musculus
tttttgctcctcctgaagttcctga

SEQ ID NO: 982198 - DNA, 25 bp, Mus musculus
tttttgctcctcgtgaagttcctga

SEQ ID NO: 982199 - DNA, 25 bp, Mus musculus
tttttgctccttacagctgtggtaa

SEQ ID NO: 982200 - DNA, 25 bp, Mus musculus
tttttgctcctttcagctgtggtaa

SEQ ID NO: 982201 - DNA, 25 bp, Mus musculus
tttttgctctagattgcttcacagt

SEQ ID NO: 982202 - DNA, 25 bp, Mus musculus
tttttgctctagtttgcttcacagt

SEQ ID NO: 982203 - DNA, 25 bp, Mus musculus
tttttgctgaggatatcccgtgtca

SEQ ID NO: 982204 - DNA, 25 bp, Mus musculus
tttttgctgaggttatcccgtgtca

SEQ ID NO: 982205 - DNA, 25 bp, Mus musculus
tttttgctgcaccaacacatcagag

SEQ ID NO: 982206 - DNA, 25 bp, Mus musculus
tttttgctgcacgaacacatcagag

SEQ ID NO: 982207 - DNA, 25 bp, Mus musculus
tttttgctgcctcttcgggctttga

SEQ ID NO: 982208 - DNA, 25 bp, Mus musculus
tttttgctgcctgttcgggctttga

SEQ ID NO: 982209 - DNA, 25 bp, Mus musculus
tttttgctgggccttgtatgccaac

SEQ ID NO: 982210 - DNA, 25 bp, Mus musculus
tttttgctgggcgttgtatgccaac

SEQ ID NO: 982211 - DNA, 25 bp, Mus musculus
tttttgctgtctcgccattgtgtcc

SEQ ID NO: 982212 - DNA, 25 bp, Mus musculus
tttttgctgtctggccattgtgtcc

SEQ ID NO: 982213 - DNA, 25 bp, Mus musculus
tttttgctgttgagtctgtagacat

SEQ ID NO: 982214 - DNA, 25 bp, Mus musculus
tttttgctgttgtgtctgtagacat

SEQ ID NO: 982215 - DNA, 25 bp, Mus musculus
tttttgctgtttcaaccacccaata

SEQ ID NO: 982216 - DNA, 25 bp, Mus musculus
tttttgctgtttgaaccacccaata

SEQ ID NO: 982217 - DNA, 25 bp, Mus musculus
tttttgcttggaacgcctccctgtg

SEQ ID NO: 982218 - DNA, 25 bp, Mus musculus
tttttgcttggatcgcctccctgtg

SEQ ID NO: 982219 - DNA, 25 bp, Mus musculus
tttttgcttgtgcaacctgagccag

SEQ ID NO: 982220 - DNA, 25 bp, Mus musculus
tttttgcttgtggaacctgagccag

SEQ ID NO: 982221 - DNA, 25 bp, Mus musculus
tttttgcttgttagattaatgggtt

SEQ ID NO: 982222 - DNA, 25 bp, Mus musculus
tttttgcttgtttgattaatgggtt

SEQ ID NO: 982223 - DNA, 25 bp, Mus musculus
tttttgctttggcagcgggtagtgg

SEQ ID NO: 982224 - DNA, 25 bp, Mus musculus
tttttgctttgggagcgggtagtgg

SEQ ID NO: 982225 - DNA, 25 bp, Mus musculus
tttttggaagtcatctgaggctgcc

SEQ ID NO: 982226 - DNA, 25 bp, Mus musculus
tttttggaagtcttctgaggctgcc

SEQ ID NO: 982227 - DNA, 25 bp, Mus musculus
tttttggacctgaggagcgaaccca

SEQ ID NO: 982228 - DNA, 25 bp, Mus musculus
tttttggacctgtggagcgaaccca

SEQ ID NO: 982229 - DNA, 25 bp, Mus musculus
tttttggagtttcgtgttcccgcag

SEQ ID NO: 982230 - DNA, 25 bp, Mus musculus
tttttggagtttggtgttcccgcag

SEQ ID NO: 982231 - DNA, 25 bp, Mus musculus
tttttggatctgagcctcttaagga

SEQ ID NO: 982232 - DNA, 25 bp, Mus musculus
tttttggatctgtgcctcttaagga

SEQ ID NO: 982233 - DNA, 25 bp, Mus musculus
tttttggatgaaaagcgtgcccgtc

SEQ ID NO: 982234 - DNA, 25 bp, Mus musculus
tttttggatgaatagcgtgcccgtc

SEQ ID NO: 982235 - DNA, 25 bp, Mus musculus
tttttggatggcactggacaggcat

SEQ ID NO: 982236 - DNA, 25 bp, Mus musculus
tttttggatggctctggacaggcat

SEQ ID NO: 982237 - DNA, 25 bp, Mus musculus
tttttggatttgatctccggacatc

SEQ ID NO: 982238 - DNA, 25 bp, Mus musculus
tttttggatttgttctccggacatc

SEQ ID NO: 982239 - DNA, 25 bp, Mus musculus
tttttggcacatattttactgagca

SEQ ID NO: 982240 - DNA, 25 bp, Mus musculus
tttttggcacattttttactgagca

SEQ ID NO: 982241 - DNA, 25 bp, Mus musculus
tttttggcaggacgaatggcacaga

SEQ ID NO: 982242 - DNA, 25 bp, Mus musculus
tttttggcaggaggaatggcacaga

SEQ ID NO: 982243 - DNA, 25 bp, Mus musculus
tttttggcattgaacaaacaccatg

SEQ ID NO: 982244 - DNA, 25 bp, Mus musculus
tttttggcattgtacaaacaccatg

SEQ ID NO: 982245 - DNA, 25 bp, Mus musculus
tttttggccactctcttacccttcg

SEQ ID NO: 982246 - DNA, 25 bp, Mus musculus
tttttggccactgtcttacccttcg

SEQ ID NO: 982247 - DNA, 25 bp, Mus musculus
tttttggccatgatctcttttccct

SEQ ID NO: 982248 - DNA, 25 bp, Mus musculus
tttttggccatgttctcttttccct

SEQ ID NO: 982249 - DNA, 25 bp, Mus musculus
tttttggccccgaaatgttcataat

SEQ ID NO: 982250 - DNA, 25 bp, Mus musculus
tttttggccccgtaatgttcataat

SEQ ID NO: 982251 - DNA, 25 bp, Mus musculus
tttttggccgccaccgatgggtcat

SEQ ID NO: 982252 - DNA, 25 bp, Mus musculus
tttttggccgcctccgatgggtcat

SEQ ID NO: 982253 - DNA, 25 bp, Mus musculus
tttttggccgctagacccaaggtag

SEQ ID NO: 982254 - DNA, 25 bp, Mus musculus
tttttggccgcttgacccaaggtag

SEQ ID NO: 982255 - DNA, 25 bp, Mus musculus
tttttggccttcataacagccctgc

SEQ ID NO: 982256 - DNA, 25 bp, Mus musculus
tttttggccttcttaacagccctgc

SEQ ID NO: 982257 - DNA, 25 bp, Mus musculus
tttttggctaggagcataagctgcc

SEQ ID NO: 982258 - DNA, 25 bp, Mus musculus
tttttggctaggtgcataagctgcc

SEQ ID NO: 982259 - DNA, 25 bp, Mus musculus
tttttggcttttcagtgtctttaca

SEQ ID NO: 982260 - DNA, 25 bp, Mus musculus
tttttggcttttgagtgtctttaca

SEQ ID NO: 982261 - DNA, 25 bp, Mus musculus
tttttgggaagcagcgctctcctaa

SEQ ID NO: 982262 - DNA, 25 bp, Mus musculus
tttttgggaagctgcgctctcctaa

SEQ ID NO: 982263 - DNA, 25 bp, Mus musculus
tttttgggcacccagcatgcatgtg

SEQ ID NO: 982264 - DNA, 25 bp, Mus musculus
tttttgggcaccgagcatgcatgtg

SEQ ID NO: 982265 - DNA, 25 bp, Mus musculus
tttttgggccttcatagggtccatt

SEQ ID NO: 982266 - DNA, 25 bp, Mus musculus
tttttgggccttcgacataaactag

SEQ ID NO: 982267 - DNA, 25 bp, Mus musculus
tttttgggccttgatagggtccatt

SEQ ID NO: 982268 - DNA, 25 bp, Mus musculus
tttttgggccttggacataaactag

SEQ ID NO: 982269 - DNA, 25 bp, Mus musculus
tttttgggtaggagacacgtggact

SEQ ID NO: 982270 - DNA, 25 bp, Mus musculus
tttttgggtaggtgacacgtggact

SEQ ID NO: 982271 - DNA, 25 bp, Mus musculus
tttttgggtcaactgccattgaagc

SEQ ID NO: 982272 - DNA, 25 bp, Mus musculus
tttttgggtcaagtgccattgaagc

SEQ ID NO: 982273 - DNA, 25 bp, Mus musculus
tttttgggtcacatgcttttgatat

SEQ ID NO: 982274 - DNA, 25 bp, Mus musculus
tttttgggtcacttgcttttgatat

SEQ ID NO: 982275 - DNA, 25 bp, Mus musculus
tttttgggttctaggtcttatcaat

SEQ ID NO: 982276 - DNA, 25 bp, Mus musculus
tttttgggttcttggtcttatcaat

SEQ ID NO: 982277 - DNA, 25 bp, Mus musculus
tttttgggttttacaggctacactg

SEQ ID NO: 982278 - DNA, 25 bp, Mus musculus
tttttgggtttttcaggctacactg

SEQ ID NO: 982279 - DNA, 25 bp, Mus musculus
tttttggtaatgatttagactgcct

SEQ ID NO: 982280 - DNA, 25 bp, Mus musculus
tttttggtaatgttttagactgcct

SEQ ID NO: 982281 - DNA, 25 bp, Mus musculus
tttttggtattaaagggcctcacag

SEQ ID NO: 982282 - DNA, 25 bp, Mus musculus
tttttggtattatagggcctcacag

SEQ ID NO: 982283 - DNA, 25 bp, Mus musculus
tttttggtcaacatttcatgctaga

SEQ ID NO: 982284 - DNA, 25 bp, Mus musculus
tttttggtcaacttttcatgctaga

SEQ ID NO: 982285 - DNA, 25 bp, Mus musculus
tttttggtcaggagccattgaggca

SEQ ID NO: 982286 - DNA, 25 bp, Mus musculus
tttttggtcaggtgccattgaggca

SEQ ID NO: 982287 - DNA, 25 bp, Mus musculus
tttttggtccacctttactctcttg

SEQ ID NO: 982288 - DNA, 25 bp, Mus musculus
tttttggtccacgtttactctcttg

SEQ ID NO: 982289 - DNA, 25 bp, Mus musculus
tttttggtgtccctttgtattgaat

SEQ ID NO: 982290 - DNA, 25 bp, Mus musculus
tttttggtgtccgtttgtattgaat

SEQ ID NO: 982291 - DNA, 25 bp, Mus musculus
tttttggtgtctacgttccctgtca

SEQ ID NO: 982292 - DNA, 25 bp, Mus musculus
tttttggtgtcttcgttccctgtca

SEQ ID NO: 982293 - DNA, 25 bp, Mus musculus
tttttggttccaaggcatcagggtt

SEQ ID NO: 982294 - DNA, 25 bp, Mus musculus
tttttggttccatggcatcagggtt

SEQ ID NO: 982295 - DNA, 25 bp, Mus musculus
tttttggtttctatgaaggctatag

SEQ ID NO: 982296 - DNA, 25 bp, Mus musculus
tttttggtttctttgaaggctatag

SEQ ID NO: 982297 - DNA, 25 bp, Mus musculus
tttttgtaaaccatcccgtccacag

SEQ ID NO: 982298 - DNA, 25 bp, Mus musculus
tttttgtaaaccttcccgtccacag

SEQ ID NO: 982299 - DNA, 25 bp, Mus musculus
tttttgtaaatgattgtcagggaag

SEQ ID NO: 982300 - DNA, 25 bp, Mus musculus
tttttgtaaatgtttgtcagggaag

SEQ ID NO: 982301 - DNA, 25 bp, Mus musculus
tttttgtaagtcatcgcataacggg

SEQ ID NO: 982302 - DNA, 25 bp, Mus musculus
tttttgtaagtcttcgcataacggg

SEQ ID NO: 982303 - DNA, 25 bp, Mus musculus
tttttgtaccagatcctcagcttaa

SEQ ID NO: 982304 - DNA, 25 bp, Mus musculus
tttttgtaccagttcctcagcttaa

SEQ ID NO: 982305 - DNA, 25 bp, Mus musculus
tttttgtactgccacttctcaacat

SEQ ID NO: 982306 - DNA, 25 bp, Mus musculus
tttttgtactgcgacttctcaacat

SEQ ID NO: 982307 - DNA, 25 bp, Mus musculus
tttttgtactggaatttaccttgat

SEQ ID NO: 982308 - DNA, 25 bp, Mus musculus
tttttgtactggtatttaccttgat

SEQ ID NO: 982309 - DNA, 25 bp, Mus musculus
tttttgtagctgactgagtgtgtta

SEQ ID NO: 982310 - DNA, 25 bp, Mus musculus
tttttgtagctgtctgagtgtgtta

SEQ ID NO: 982311 - DNA, 25 bp, Mus musculus
tttttgtagcttctagcccagtctg

SEQ ID NO: 982312 - DNA, 25 bp, Mus musculus
tttttgtagcttgtagcccagtctg

SEQ ID NO: 982313 - DNA, 25 bp, Mus musculus
tttttgtataggagcccaggcaggg

SEQ ID NO: 982314 - DNA, 25 bp, Mus musculus
tttttgtataggtgcccaggcaggg

SEQ ID NO: 982315 - DNA, 25 bp, Mus musculus
tttttgtcaataatccattgctgtg

SEQ ID NO: 982316 - DNA, 25 bp, Mus musculus
tttttgtcaatattccattgctgtg

SEQ ID NO: 982317 - DNA, 25 bp, Mus musculus
tttttgtcaccgaggaagtcattcc

SEQ ID NO: 982318 - DNA, 25 bp, Mus musculus
tttttgtcaccgtggaagtcattcc

SEQ ID NO: 982319 - DNA, 25 bp, Mus musculus
tttttgtccagtactgtacaacttg

SEQ ID NO: 982320 - DNA, 25 bp, Mus musculus
tttttgtccagtctccgtgtctttc

SEQ ID NO: 982321 - DNA, 25 bp, Mus musculus
tttttgtccagtgtccgtgtctttc

SEQ ID NO: 982322 - DNA, 25 bp, Mus musculus
tttttgtccagttctgtacaacttg

SEQ ID NO: 982323 - DNA, 25 bp, Mus musculus
tttttgtcctcacgttgttgcccta

SEQ ID NO: 982324 - DNA, 25 bp, Mus musculus
tttttgtcctcaggttgttgcccta

SEQ ID NO: 982325 - DNA, 25 bp, Mus musculus
tttttgtcctggactgttgacagac

SEQ ID NO: 982326 - DNA, 25 bp, Mus musculus
tttttgtcctggtctgttgacagac

SEQ ID NO: 982327 - DNA, 25 bp, Mus musculus
tttttgtcctgtacatgtgtctatg

SEQ ID NO: 982328 - DNA, 25 bp, Mus musculus
tttttgtcctgttcatgtgtctatg

SEQ ID NO: 982329 - DNA, 25 bp, Mus musculus
tttttgtcctttaaagtgtcgctgg

SEQ ID NO: 982330 - DNA, 25 bp, Mus musculus
tttttgtccttttaagtgtcgctgg

SEQ ID NO: 982331 - DNA, 25 bp, Mus musculus
tttttgtctcagctttgttttgata

SEQ ID NO: 982332 - DNA, 25 bp, Mus musculus
tttttgtctcaggtttgttttgata

SEQ ID NO: 982333 - DNA, 25 bp, Mus musculus
tttttgtctcatacatctaaataga

SEQ ID NO: 982334 - DNA, 25 bp, Mus musculus
tttttgtctcattcatctaaataga

SEQ ID NO: 982335 - DNA, 25 bp, Mus musculus
tttttgtctcctaccagcacatgtg

SEQ ID NO: 982336 - DNA, 25 bp, Mus musculus
tttttgtctccttccagcacatgtg

SEQ ID NO: 982337 - DNA, 25 bp, Mus musculus
tttttgtctcttaaatccctcacct

SEQ ID NO: 982338 - DNA, 25 bp, Mus musculus
tttttgtctctttaatccctcacct

SEQ ID NO: 982339 - DNA, 25 bp, Mus musculus
tttttgtctgtgatgccatcccagg

SEQ ID NO: 982340 - DNA, 25 bp, Mus musculus
tttttgtctgtgttgccatcccagg

SEQ ID NO: 982341 - DNA, 25 bp, Mus musculus
tttttgtgaccacgcgagacgcact

SEQ ID NO: 982342 - DNA, 25 bp, Mus musculus
tttttgtgaccaggcgagacgcact

SEQ ID NO: 982343 - DNA, 25 bp, Mus musculus
tttttgtgacttcttctgataagat

SEQ ID NO: 982344 - DNA, 25 bp, Mus musculus
tttttgtgacttgttctgataagat

SEQ ID NO: 982345 - DNA, 25 bp, Mus musculus
tttttgtgagcaattctgaccttct

SEQ ID NO: 982346 - DNA, 25 bp, Mus musculus
tttttgtgagcatttctgaccttct

SEQ ID NO: 982347 - DNA, 25 bp, Mus musculus
tttttgtgagttcggcagctgcagt

SEQ ID NO: 982348 - DNA, 25 bp, Mus musculus
tttttgtgagttgggcagctgcagt

SEQ ID NO: 982349 - DNA, 25 bp, Mus musculus
tttttgtgatagagaagacattgcc

SEQ ID NO: 982350 - DNA, 25 bp, Mus musculus
tttttgtgatagtgaagacattgcc

SEQ ID NO: 982351 - DNA, 25 bp, Mus musculus
tttttgtgattaaggctccccttct

SEQ ID NO: 982352 - DNA, 25 bp, Mus musculus
tttttgtgattatggctccccttct

SEQ ID NO: 982353 - DNA, 25 bp, Mus musculus
tttttgtgcattacgactcagttgg

SEQ ID NO: 982354 - DNA, 25 bp, Mus musculus
tttttgtgcatttcgactcagttgg

SEQ ID NO: 982355 - DNA, 25 bp, Mus musculus
tttttgtgccttcgtgatcctttta

SEQ ID NO: 982356 - DNA, 25 bp, Mus musculus
tttttgtgccttggtgatcctttta

SEQ ID NO: 982357 - DNA, 25 bp, Mus musculus
tttttgtggattaagagcgagtctt

SEQ ID NO: 982358 - DNA, 25 bp, Mus musculus
tttttgtggatttagagcgagtctt

SEQ ID NO: 982359 - DNA, 25 bp, Mus musculus
tttttgtggctaaccaacctctcaa

SEQ ID NO: 982360 - DNA, 25 bp, Mus musculus
tttttgtggctatccaacctctcaa

SEQ ID NO: 982361 - DNA, 25 bp, Mus musculus
tttttgtggctgagaccctttgtca

SEQ ID NO: 982362 - DNA, 25 bp, Mus musculus
tttttgtggctgtgaccctttgtca

SEQ ID NO: 982363 - DNA, 25 bp, Mus musculus
tttttgtgggaaagggccctgcttt

SEQ ID NO: 982364 - DNA, 25 bp, Mus musculus
tttttgtgggaatgggccctgcttt

SEQ ID NO: 982365 - DNA, 25 bp, Mus musculus
tttttgtgtattcctcagatctgca

SEQ ID NO: 982366 - DNA, 25 bp, Mus musculus
tttttgtgtattgctcagatctgca

SEQ ID NO: 982367 - DNA, 25 bp, Mus musculus
tttttgtgtgtgaatcagcccactt

SEQ ID NO: 982368 - DNA, 25 bp, Mus musculus
tttttgtgtgtgtatcagcccactt

SEQ ID NO: 982369 - DNA, 25 bp, Mus musculus
tttttgtgtttgaggcagactcact

SEQ ID NO: 982370 - DNA, 25 bp, Mus musculus
tttttgtgtttgtggcagactcact

SEQ ID NO: 982371 - DNA, 25 bp, Mus musculus
tttttgttatacaccccatccatga

SEQ ID NO: 982372 - DNA, 25 bp, Mus musculus
tttttgttatactccccatccatga

SEQ ID NO: 982373 - DNA, 25 bp, Mus musculus
tttttgttcaggatagcttcagctt

SEQ ID NO: 982374 - DNA, 25 bp, Mus musculus
tttttgttcaggttagcttcagctt

SEQ ID NO: 982375 - DNA, 25 bp, Mus musculus
tttttgttccaaataagtcctcgtg

SEQ ID NO: 982376 - DNA, 25 bp, Mus musculus
tttttgttccaattaagtcctcgtg

SEQ ID NO: 982377 - DNA, 25 bp, Mus musculus
tttttgttcctaaagctctcagtgt

SEQ ID NO: 982378 - DNA, 25 bp, Mus musculus
tttttgttcctatagctctcagtgt

SEQ ID NO: 982379 - DNA, 25 bp, Mus musculus
tttttgttcgccactgcctattgca

SEQ ID NO: 982380 - DNA, 25 bp, Mus musculus
tttttgttcgcctctgcctattgca

SEQ ID NO: 982381 - DNA, 25 bp, Mus musculus
tttttgttcttaactcctcggatca

SEQ ID NO: 982382 - DNA, 25 bp, Mus musculus
tttttgttcttatctcctcggatca

SEQ ID NO: 982383 - DNA, 25 bp, Mus musculus
tttttgttcttcctgaacctgggca

SEQ ID NO: 982384 - DNA, 25 bp, Mus musculus
tttttgttcttcgtgaacctgggca

SEQ ID NO: 982385 - DNA, 25 bp, Mus musculus
tttttgttcttgaatggcagccctt

SEQ ID NO: 982386 - DNA, 25 bp, Mus musculus
tttttgttcttgtatggcagccctt

SEQ ID NO: 982387 - DNA, 25 bp, Mus musculus
tttttgttgtaaccatgacccatgg

SEQ ID NO: 982388 - DNA, 25 bp, Mus musculus
tttttgttgtaagcatgacccatgg

SEQ ID NO: 982389 - DNA, 25 bp, Mus musculus
tttttgtttatgaagatggccaggt

SEQ ID NO: 982390 - DNA, 25 bp, Mus musculus
tttttgtttatgtagatggccaggt

SEQ ID NO: 982391 - DNA, 25 bp, Mus musculus
tttttgtttctgagacccagcacct

SEQ ID NO: 982392 - DNA, 25 bp, Mus musculus
tttttgtttctgcatgctctgtcat

SEQ ID NO: 982393 - DNA, 25 bp, Mus musculus
tttttgtttctggatgctctgtcat

SEQ ID NO: 982394 - DNA, 25 bp, Mus musculus
tttttgtttctgtgacccagcacct

SEQ ID NO: 982395 - DNA, 25 bp, Mus musculus
tttttgtttgaaatgttgcaatgtt

SEQ ID NO: 982396 - DNA, 25 bp, Mus musculus
tttttgtttgaattgttgcaatgtt

SEQ ID NO: 982397 - DNA, 25 bp, Mus musculus
tttttgtttgctctcacgtagccca

SEQ ID NO: 982398 - DNA, 25 bp, Mus musculus
tttttgtttgctgtcacgtagccca

SEQ ID NO: 982399 - DNA, 25 bp, Mus musculus
tttttgtttgtcatgatgctgcccc

SEQ ID NO: 982400 - DNA, 25 bp, Mus musculus
tttttgtttgtcttgatgctgcccc

SEQ ID NO: 982401 - DNA, 25 bp, Mus musculus
tttttgttttcacggagtgattcca

SEQ ID NO: 982402 - DNA, 25 bp, Mus musculus
tttttgttttcagggagtgattcca

SEQ ID NO: 982403 - DNA, 25 bp, Mus musculus
tttttgttttgtcgcagaccgtact

SEQ ID NO: 982404 - DNA, 25 bp, Mus musculus
tttttgttttgtggcagaccgtact

SEQ ID NO: 982405 - DNA, 25 bp, Mus musculus
tttttgtttttgagcgtgcgtgcgc

SEQ ID NO: 982406 - DNA, 25 bp, Mus musculus
tttttgtttttgtgcgtgcgtgcgc

SEQ ID NO: 982407 - DNA, 25 bp, Mus musculus
ttttttaaattcctgtggctgtgtg

SEQ ID NO: 982408 - DNA, 25 bp, Mus musculus
ttttttaaattcgtgtggctgtgtg

SEQ ID NO: 982409 - DNA, 25 bp, Mus musculus
ttttttaaccatccatcctgtgcaa

SEQ ID NO: 982410 - DNA, 25 bp, Mus musculus
ttttttaaccatgcatcctgtgcaa

SEQ ID NO: 982411 - DNA, 25 bp, Mus musculus
ttttttaacctaagagtacctcacg

SEQ ID NO: 982412 - DNA, 25 bp, Mus musculus
ttttttaacctatgagtacctcacg

SEQ ID NO: 982413 - DNA, 25 bp, Mus musculus
ttttttaactctcggcttagctgtg

SEQ ID NO: 982414 - DNA, 25 bp, Mus musculus
ttttttaactctgggcttagctgtg

SEQ ID NO: 982415 - DNA, 25 bp, Mus musculus
ttttttaagcgacttgcctctctcc

SEQ ID NO: 982416 - DNA, 25 bp, Mus musculus
ttttttaagcgagttgcctctctcc

SEQ ID NO: 982417 - DNA, 25 bp, Mus musculus
ttttttaagctcacctgggctcaca

SEQ ID NO: 982418 - DNA, 25 bp, Mus musculus
ttttttaagctctcctgggctcaca

SEQ ID NO: 982419 - DNA, 25 bp, Mus musculus
ttttttaagttaccagctcatgtat

SEQ ID NO: 982420 - DNA, 25 bp, Mus musculus
ttttttaagttagcagctcatgtat

SEQ ID NO: 982421 - DNA, 25 bp, Mus musculus
ttttttaatatgaggacgctgcaaa

SEQ ID NO: 982422 - DNA, 25 bp, Mus musculus
ttttttaatatgtggacgctgcaaa

SEQ ID NO: 982423 - DNA, 25 bp, Mus musculus
ttttttaatcctccattgtgcctag

SEQ ID NO: 982424 - DNA, 25 bp, Mus musculus
ttttttaatcctgcattgtgcctag

SEQ ID NO: 982425 - DNA, 25 bp, Mus musculus
ttttttaatctccttccacgacgtg

SEQ ID NO: 982426 - DNA, 25 bp, Mus musculus
ttttttaatctcgttccacgacgtg

SEQ ID NO: 982427 - DNA, 25 bp, Mus musculus
ttttttaatctgctgctcaattgta

SEQ ID NO: 982428 - DNA, 25 bp, Mus musculus
ttttttaatctggtgctcaattgta

SEQ ID NO: 982429 - DNA, 25 bp, Mus musculus
ttttttaatgacagtaccaggcctt

SEQ ID NO: 982430 - DNA, 25 bp, Mus musculus
ttttttaatgactgtaccaggcctt

SEQ ID NO: 982431 - DNA, 25 bp, Mus musculus
ttttttaatgtcactgtggagtatt

SEQ ID NO: 982432 - DNA, 25 bp, Mus musculus
ttttttaatgtctctgtggagtatt

SEQ ID NO: 982433 - DNA, 25 bp, Mus musculus
ttttttaattcaacacactctcctc

SEQ ID NO: 982434 - DNA, 25 bp, Mus musculus
ttttttaattcatcacactctcctc

SEQ ID NO: 982435 - DNA, 25 bp, Mus musculus
ttttttacaaggaaggcaggtacag

SEQ ID NO: 982436 - DNA, 25 bp, Mus musculus
ttttttacaaggtaggcaggtacag

SEQ ID NO: 982437 - DNA, 25 bp, Mus musculus
ttttttacaagtctcagctcctctt

SEQ ID NO: 982438 - DNA, 25 bp, Mus musculus
ttttttacaagtgtcagctcctctt

SEQ ID NO: 982439 - DNA, 25 bp, Mus musculus
ttttttacaccacaactcatccttt

SEQ ID NO: 982440 - DNA, 25 bp, Mus musculus
ttttttacaccagaactcatccttt

SEQ ID NO: 982441 - DNA, 25 bp, Mus musculus
ttttttacattaacaccacagcagg

SEQ ID NO: 982442 - DNA, 25 bp, Mus musculus
ttttttacattatcaccacagcagg

SEQ ID NO: 982443 - DNA, 25 bp, Mus musculus
ttttttacccacaactacacattgt

SEQ ID NO: 982444 - DNA, 25 bp, Mus musculus
ttttttacccactactacacattgt

SEQ ID NO: 982445 - DNA, 25 bp, Mus musculus
ttttttacctcaatttcctgcgtgc

SEQ ID NO: 982446 - DNA, 25 bp, Mus musculus
ttttttacctcactatctctcattt

SEQ ID NO: 982447 - DNA, 25 bp, Mus musculus
ttttttacctcagtatctctcattt

SEQ ID NO: 982448 - DNA, 25 bp, Mus musculus
ttttttacctcattttcctgcgtgc

SEQ ID NO: 982449 - DNA, 25 bp, Mus musculus
ttttttacctgtagagacatgaaaa

SEQ ID NO: 982450 - DNA, 25 bp, Mus musculus
ttttttacctgttgagacatgaaaa

SEQ ID NO: 982451 - DNA, 25 bp, Mus musculus
ttttttacggttctctgtgtcacca

SEQ ID NO: 982452 - DNA, 25 bp, Mus musculus
ttttttacggttgtctgtgtcacca

SEQ ID NO: 982453 - DNA, 25 bp, Mus musculus
ttttttacgtttagctatctcacct

SEQ ID NO: 982454 - DNA, 25 bp, Mus musculus
ttttttacgttttgctatctcacct

SEQ ID NO: 982455 - DNA, 25 bp, Mus musculus
ttttttactcacatttgtttcctgc

SEQ ID NO: 982456 - DNA, 25 bp, Mus musculus
ttttttactcacttttgtttcctgc

SEQ ID NO: 982457 - DNA, 25 bp, Mus musculus
ttttttactgacctgatgtgttgga

SEQ ID NO: 982458 - DNA, 25 bp, Mus musculus
ttttttactgacgtgatgtgttgga

SEQ ID NO: 982459 - DNA, 25 bp, Mus musculus
ttttttactgctcgagattctcgtg

SEQ ID NO: 982460 - DNA, 25 bp, Mus musculus
ttttttactgctggagattctcgtg

SEQ ID NO: 982461 - DNA, 25 bp, Mus musculus
ttttttactttccttactcatcgct

SEQ ID NO: 982462 - DNA, 25 bp, Mus musculus
ttttttactttcgttactcatcgct

SEQ ID NO: 982463 - DNA, 25 bp, Mus musculus
ttttttagagtaacacgacgcacaa

SEQ ID NO: 982464 - DNA, 25 bp, Mus musculus
ttttttagagtatcacgacgcacaa

SEQ ID NO: 982465 - DNA, 25 bp, Mus musculus
ttttttagattcatgtgtagtccag

SEQ ID NO: 982466 - DNA, 25 bp, Mus musculus
ttttttagattcttgtgtagtccag

SEQ ID NO: 982467 - DNA, 25 bp, Mus musculus
ttttttagcaccacaccagacataa

SEQ ID NO: 982468 - DNA, 25 bp, Mus musculus
ttttttagcacctcaccagacataa

SEQ ID NO: 982469 - DNA, 25 bp, Mus musculus
ttttttagcagaagtcagtattcca

SEQ ID NO: 982470 - DNA, 25 bp, Mus musculus
ttttttagcagatgtcagtattcca

SEQ ID NO: 982471 - DNA, 25 bp, Mus musculus
ttttttagcagtataatgggtacat

SEQ ID NO: 982472 - DNA, 25 bp, Mus musculus
ttttttagcagtttaatgggtacat

SEQ ID NO: 982473 - DNA, 25 bp, Mus musculus
ttttttagtcatcggctgaccacac

SEQ ID NO: 982474 - DNA, 25 bp, Mus musculus
ttttttagtcatgggctgaccacac

SEQ ID NO: 982475 - DNA, 25 bp, Mus musculus
ttttttagtccaactactgcccatg

SEQ ID NO: 982476 - DNA, 25 bp, Mus musculus
ttttttagtccaagcatctttgcat

SEQ ID NO: 982477 - DNA, 25 bp, Mus musculus
ttttttagtccatctactgcccatg

SEQ ID NO: 982478 - DNA, 25 bp, Mus musculus
ttttttagtccatgcatctttgcat

SEQ ID NO: 982479 - DNA, 25 bp, Mus musculus
ttttttagtgtgcttttccgctcat

SEQ ID NO: 982480 - DNA, 25 bp, Mus musculus
ttttttagtgtggttttccgctcat

SEQ ID NO: 982481 - DNA, 25 bp, Mus musculus
ttttttatacacatggtctttccat

SEQ ID NO: 982482 - DNA, 25 bp, Mus musculus
ttttttatacacttggtctttccat

SEQ ID NO: 982483 - DNA, 25 bp, Mus musculus
ttttttatacgtccagccccttcct

SEQ ID NO: 982484 - DNA, 25 bp, Mus musculus
ttttttatacgtgcagccccttcct

SEQ ID NO: 982485 - DNA, 25 bp, Mus musculus
ttttttatatcaagctacatcattt

SEQ ID NO: 982486 - DNA, 25 bp, Mus musculus
ttttttatatcatgctacatcattt

SEQ ID NO: 982487 - DNA, 25 bp, Mus musculus
ttttttatcagaatattgcccagtc

SEQ ID NO: 982488 - DNA, 25 bp, Mus musculus
ttttttatcagattattgcccagtc

SEQ ID NO: 982489 - DNA, 25 bp, Mus musculus
ttttttatctctccatgagctgtta

SEQ ID NO: 982490 - DNA, 25 bp, Mus musculus
ttttttatctctgcatgagctgtta

SEQ ID NO: 982491 - DNA, 25 bp, Mus musculus
ttttttatctttcaccttcatggct

SEQ ID NO: 982492 - DNA, 25 bp, Mus musculus
ttttttatctttgaccttcatggct

SEQ ID NO: 982493 - DNA, 25 bp, Mus musculus
ttttttatgatgcactccctcccag

SEQ ID NO: 982494 - DNA, 25 bp, Mus musculus
ttttttatgatggactccctcccag

SEQ ID NO: 982495 - DNA, 25 bp, Mus musculus
ttttttatgtctctacccaatcctt

SEQ ID NO: 982496 - DNA, 25 bp, Mus musculus
ttttttatgtctgtacccaatcctt

SEQ ID NO: 982497 - DNA, 25 bp, Mus musculus
ttttttattctaagcctttttactg

SEQ ID NO: 982498 - DNA, 25 bp, Mus musculus
ttttttattctatgcctttttactg

SEQ ID NO: 982499 - DNA, 25 bp, Mus musculus
ttttttattgaacccacccactcag

SEQ ID NO: 982500 - DNA, 25 bp, Mus musculus
ttttttattgaagccacccactcag

SEQ ID NO: 982501 - DNA, 25 bp, Mus musculus
ttttttattgtgatagatttctcct

SEQ ID NO: 982502 - DNA, 25 bp, Mus musculus
ttttttattgtgttagatttctcct

SEQ ID NO: 982503 - DNA, 25 bp, Mus musculus
ttttttatttatactcacggtgcag

SEQ ID NO: 982504 - DNA, 25 bp, Mus musculus
ttttttatttattctcacggtgcag

SEQ ID NO: 982505 - DNA, 25 bp, Mus musculus
ttttttattttaatagtcttgccag

SEQ ID NO: 982506 - DNA, 25 bp, Mus musculus
ttttttattttattagtcttgccag

SEQ ID NO: 982507 - DNA, 25 bp, Mus musculus
ttttttattttcagatgactccaag

SEQ ID NO: 982508 - DNA, 25 bp, Mus musculus
ttttttattttctgatgactccaag

SEQ ID NO: 982509 - DNA, 25 bp, Mus musculus
ttttttcaaacacactagcagggct

SEQ ID NO: 982510 - DNA, 25 bp, Mus musculus
ttttttcaaacagactagcagggct

SEQ ID NO: 982511 - DNA, 25 bp, Mus musculus
ttttttcaaagacccaccctgagca

SEQ ID NO: 982512 - DNA, 25 bp, Mus musculus
ttttttcaaagagccaccctgagca

SEQ ID NO: 982513 - DNA, 25 bp, Mus musculus
ttttttcaacatcctttcaatctgt

SEQ ID NO: 982514 - DNA, 25 bp, Mus musculus
ttttttcaacatgctttcaatctgt

SEQ ID NO: 982515 - DNA, 25 bp, Mus musculus
ttttttcaatgtagggacatacaga

SEQ ID NO: 982516 - DNA, 25 bp, Mus musculus
ttttttcaatgtccaaatcaagagt

SEQ ID NO: 982517 - DNA, 25 bp, Mus musculus
ttttttcaatgtgcaaatcaagagt

SEQ ID NO: 982518 - DNA, 25 bp, Mus musculus
ttttttcaatgttgggacatacaga

SEQ ID NO: 982519 - DNA, 25 bp, Mus musculus
ttttttcaattaacagagtctctga

SEQ ID NO: 982520 - DNA, 25 bp, Mus musculus
ttttttcaattatcagagtctctga

SEQ ID NO: 982521 - DNA, 25 bp, Mus musculus
ttttttcacaaccttactctcaaat

SEQ ID NO: 982522 - DNA, 25 bp, Mus musculus
ttttttcacaacgttactctcaaat

SEQ ID NO: 982523 - DNA, 25 bp, Mus musculus
ttttttcacaccaccatgaagagat

SEQ ID NO: 982524 - DNA, 25 bp, Mus musculus
ttttttcacacctccatgaagagat

SEQ ID NO: 982525 - DNA, 25 bp, Mus musculus
ttttttcacccaagttctatccaag

SEQ ID NO: 982526 - DNA, 25 bp, Mus musculus
ttttttcacccatgttctatccaag

SEQ ID NO: 982527 - DNA, 25 bp, Mus musculus
ttttttcaccctagctagggagcta

SEQ ID NO: 982528 - DNA, 25 bp, Mus musculus
ttttttcacccttgctagggagcta

SEQ ID NO: 982529 - DNA, 25 bp, Mus musculus
ttttttcacctgctgctgtggtgtt

SEQ ID NO: 982530 - DNA, 25 bp, Mus musculus
ttttttcacctggtgctgtggtgtt

SEQ ID NO: 982531 - DNA, 25 bp, Mus musculus
ttttttcacttacacccagaatcat

SEQ ID NO: 982532 - DNA, 25 bp, Mus musculus
ttttttcacttagacccagaatcat

SEQ ID NO: 982533 - DNA, 25 bp, Mus musculus
ttttttcacttccaatatgaaggcc

SEQ ID NO: 982534 - DNA, 25 bp, Mus musculus
ttttttcacttcgaatatgaaggcc

SEQ ID NO: 982535 - DNA, 25 bp, Mus musculus
ttttttcactttcgctatatttacg

SEQ ID NO: 982536 - DNA, 25 bp, Mus musculus
ttttttcactttctagctcttggat

SEQ ID NO: 982537 - DNA, 25 bp, Mus musculus
ttttttcactttggctatatttacg

SEQ ID NO: 982538 - DNA, 25 bp, Mus musculus
ttttttcactttgtagctcttggat

SEQ ID NO: 982539 - DNA, 25 bp, Mus musculus
ttttttcagatgacctcagtatgta

SEQ ID NO: 982540 - DNA, 25 bp, Mus musculus
ttttttcagatgtcctcagtatgta

SEQ ID NO: 982541 - DNA, 25 bp, Mus musculus
ttttttcagcaaagccaccagcaga

SEQ ID NO: 982542 - DNA, 25 bp, Mus musculus
ttttttcagcaatgccaccagcaga

SEQ ID NO: 982543 - DNA, 25 bp, Mus musculus
ttttttcagcagaagcctacacgcc

SEQ ID NO: 982544 - DNA, 25 bp, Mus musculus
ttttttcagcagtagcctacacgcc

SEQ ID NO: 982545 - DNA, 25 bp, Mus musculus
ttttttcagcatacacaggtccaga

SEQ ID NO: 982546 - DNA, 25 bp, Mus musculus
ttttttcagcattcacaggtccaga

SEQ ID NO: 982547 - DNA, 25 bp, Mus musculus
ttttttcaggacaccccacacattg

SEQ ID NO: 982548 - DNA, 25 bp, Mus musculus
ttttttcaggactccccacacattg

SEQ ID NO: 982549 - DNA, 25 bp, Mus musculus
ttttttcagggtagctgtgaaacca

SEQ ID NO: 982550 - DNA, 25 bp, Mus musculus
ttttttcagggttgctgtgaaacca

SEQ ID NO: 982551 - DNA, 25 bp, Mus musculus
ttttttcagtgtcccctcagtttag

SEQ ID NO: 982552 - DNA, 25 bp, Mus musculus
ttttttcagtgtgccctcagtttag

SEQ ID NO: 982553 - DNA, 25 bp, Mus musculus
ttttttcagttgatggtctcttccc

SEQ ID NO: 982554 - DNA, 25 bp, Mus musculus
ttttttcagttgttggtctcttccc

SEQ ID NO: 982555 - DNA, 25 bp, Mus musculus
ttttttcagtttccctttcatcaga

SEQ ID NO: 982556 - DNA, 25 bp, Mus musculus
ttttttcagtttgcctttcatcaga

SEQ ID NO: 982557 - DNA, 25 bp, Mus musculus
ttttttcataaccgctgcagcagca

SEQ ID NO: 982558 - DNA, 25 bp, Mus musculus
ttttttcataacggctgcagcagca

SEQ ID NO: 982559 - DNA, 25 bp, Mus musculus
ttttttcataccactatccatctat

SEQ ID NO: 982560 - DNA, 25 bp, Mus musculus
ttttttcatacctctatccatctat

SEQ ID NO: 982561 - DNA, 25 bp, Mus musculus
ttttttcatcaaagtaggcccacaa

SEQ ID NO: 982562 - DNA, 25 bp, Mus musculus
ttttttcatcaatgtaggcccacaa

SEQ ID NO: 982563 - DNA, 25 bp, Mus musculus
ttttttcatgagctctttaaaatat

SEQ ID NO: 982564 - DNA, 25 bp, Mus musculus
ttttttcatgaggtctttaaaatat

SEQ ID NO: 982565 - DNA, 25 bp, Mus musculus
ttttttcatggaacaattgctggtt

SEQ ID NO: 982566 - DNA, 25 bp, Mus musculus
ttttttcatggatcaattgctggtt

SEQ ID NO: 982567 - DNA, 25 bp, Mus musculus
ttttttcatgtacgccgagtaaaga

SEQ ID NO: 982568 - DNA, 25 bp, Mus musculus
ttttttcatgtaggccgagtaaaga

SEQ ID NO: 982569 - DNA, 25 bp, Mus musculus
ttttttcatgtcacctagccatttg

SEQ ID NO: 982570 - DNA, 25 bp, Mus musculus
ttttttcatgtctcctagccatttg

SEQ ID NO: 982571 - DNA, 25 bp, Mus musculus
ttttttcattcaacttaattggcta

SEQ ID NO: 982572 - DNA, 25 bp, Mus musculus
ttttttcattcatcttaattggcta

SEQ ID NO: 982573 - DNA, 25 bp, Mus musculus
ttttttcattctcatcggatgcatc

SEQ ID NO: 982574 - DNA, 25 bp, Mus musculus
ttttttcattctgatcggatgcatc

SEQ ID NO: 982575 - DNA, 25 bp, Mus musculus
ttttttccaagaccgtctgcactca

SEQ ID NO: 982576 - DNA, 25 bp, Mus musculus
ttttttccaagagcgtctgcactca

SEQ ID NO: 982577 - DNA, 25 bp, Mus musculus
ttttttccaaggagtgccaacacag

SEQ ID NO: 982578 - DNA, 25 bp, Mus musculus
ttttttccaaggtgtgccaacacag

SEQ ID NO: 982579 - DNA, 25 bp, Mus musculus
ttttttccacatagggcaccacttc

SEQ ID NO: 982580 - DNA, 25 bp, Mus musculus
ttttttccacattgggcaccacttc

SEQ ID NO: 982581 - DNA, 25 bp, Mus musculus
ttttttccaccaatagccttaatga

SEQ ID NO: 982582 - DNA, 25 bp, Mus musculus
ttttttccaccattagccttaatga

SEQ ID NO: 982583 - DNA, 25 bp, Mus musculus
ttttttccactaactggcggtattt

SEQ ID NO: 982584 - DNA, 25 bp, Mus musculus
ttttttccactaagtgaacccaggg

SEQ ID NO: 982585 - DNA, 25 bp, Mus musculus
ttttttccactatctggcggtattt

SEQ ID NO: 982586 - DNA, 25 bp, Mus musculus
ttttttccactatgtgaacccaggg

SEQ ID NO: 982587 - DNA, 25 bp, Mus musculus
ttttttccagataatttatgtgcag

SEQ ID NO: 982588 - DNA, 25 bp, Mus musculus
ttttttccagattatttatgtgcag

SEQ ID NO: 982589 - DNA, 25 bp, Mus musculus
ttttttccataaatctgagcctgta

SEQ ID NO: 982590 - DNA, 25 bp, Mus musculus
ttttttccataattctgagcctgta

SEQ ID NO: 982591 - DNA, 25 bp, Mus musculus
ttttttccatcaatgtgcttgcctc

SEQ ID NO: 982592 - DNA, 25 bp, Mus musculus
ttttttccatcattgtgcttgcctc

SEQ ID NO: 982593 - DNA, 25 bp, Mus musculus
ttttttccatctcagcaccgttaaa

SEQ ID NO: 982594 - DNA, 25 bp, Mus musculus
ttttttccatctgagcaccgttaaa

SEQ ID NO: 982595 - DNA, 25 bp, Mus musculus
ttttttccattcatttctcactgtg

SEQ ID NO: 982596 - DNA, 25 bp, Mus musculus
ttttttccattcttttctcactgtg

SEQ ID NO: 982597 - DNA, 25 bp, Mus musculus
ttttttccatttcacaccgttgtat

SEQ ID NO: 982598 - DNA, 25 bp, Mus musculus
ttttttccatttgacaccgttgtat

SEQ ID NO: 982599 - DNA, 25 bp, Mus musculus
ttttttcccaacactattgactcag

SEQ ID NO: 982600 - DNA, 25 bp, Mus musculus
ttttttcccaactctattgactcag

SEQ ID NO: 982601 - DNA, 25 bp, Mus musculus
ttttttcccaagatgtgaaagtctc

SEQ ID NO: 982602 - DNA, 25 bp, Mus musculus
ttttttcccaagttgtgaaagtctc

SEQ ID NO: 982603 - DNA, 25 bp, Mus musculus
ttttttcccaccatgttcaagggtg

SEQ ID NO: 982604 - DNA, 25 bp, Mus musculus
ttttttcccaccttgttcaagggtg

SEQ ID NO: 982605 - DNA, 25 bp, Mus musculus
ttttttcccagaaactcctcatact

SEQ ID NO: 982606 - DNA, 25 bp, Mus musculus
ttttttcccagatactcctcatact

SEQ ID NO: 982607 - DNA, 25 bp, Mus musculus
ttttttcccagtactgtgttttgag

SEQ ID NO: 982608 - DNA, 25 bp, Mus musculus
ttttttcccagtccttttggcatgt

SEQ ID NO: 982609 - DNA, 25 bp, Mus musculus
ttttttcccagtgcttttggcatgt

SEQ ID NO: 982610 - DNA, 25 bp, Mus musculus
ttttttcccagttctgtgttttgag

SEQ ID NO: 982611 - DNA, 25 bp, Mus musculus
ttttttcccataccccttgcactag

SEQ ID NO: 982612 - DNA, 25 bp, Mus musculus
ttttttcccatagcccttgcactag

SEQ ID NO: 982613 - DNA, 25 bp, Mus musculus
ttttttcccatcagttcaagctcca

SEQ ID NO: 982614 - DNA, 25 bp, Mus musculus
ttttttcccatctgttcaagctcca

SEQ ID NO: 982615 - DNA, 25 bp, Mus musculus
ttttttcccatgctgtctgtgggaa

SEQ ID NO: 982616 - DNA, 25 bp, Mus musculus
ttttttcccatggtgtctgtgggaa

SEQ ID NO: 982617 - DNA, 25 bp, Mus musculus
ttttttcccattcagcattgttata

SEQ ID NO: 982618 - DNA, 25 bp, Mus musculus
ttttttcccattccatctattctga

SEQ ID NO: 982619 - DNA, 25 bp, Mus musculus
ttttttcccattgagcattgttata

SEQ ID NO: 982620 - DNA, 25 bp, Mus musculus
ttttttcccattgcatctattctga

SEQ ID NO: 982621 - DNA, 25 bp, Mus musculus
ttttttccccaacaggagaggactg

SEQ ID NO: 982622 - DNA, 25 bp, Mus musculus
ttttttccccaagaggagaggactg

SEQ ID NO: 982623 - DNA, 25 bp, Mus musculus
ttttttccccacacacagtgttgta

SEQ ID NO: 982624 - DNA, 25 bp, Mus musculus
ttttttccccactcacagtgttgta

SEQ ID NO: 982625 - DNA, 25 bp, Mus musculus
ttttttccccagaaaatgaggcaag

SEQ ID NO: 982626 - DNA, 25 bp, Mus musculus
ttttttccccagtaaatgaggcaag

SEQ ID NO: 982627 - DNA, 25 bp, Mus musculus
ttttttcccctccaagttctcagat

SEQ ID NO: 982628 - DNA, 25 bp, Mus musculus
ttttttcccctcgaagttctcagat

SEQ ID NO: 982629 - DNA, 25 bp, Mus musculus
ttttttccctctactcatacaaatc

SEQ ID NO: 982630 - DNA, 25 bp, Mus musculus
ttttttccctcttctcatacaaatc

SEQ ID NO: 982631 - DNA, 25 bp, Mus musculus
ttttttccctgcaatcagtttctgg

SEQ ID NO: 982632 - DNA, 25 bp, Mus musculus
ttttttccctgctatcagtttctgg

SEQ ID NO: 982633 - DNA, 25 bp, Mus musculus
ttttttcccttacaaggctcattct

SEQ ID NO: 982634 - DNA, 25 bp, Mus musculus
ttttttcccttagaaggctcattct

SEQ ID NO: 982635 - DNA, 25 bp, Mus musculus
ttttttccgaagcatcacaaaatct

SEQ ID NO: 982636 - DNA, 25 bp, Mus musculus
ttttttccgaaggatcacaaaatct

SEQ ID NO: 982637 - DNA, 25 bp, Mus musculus
ttttttccgcctctgaaatgcgtcc

SEQ ID NO: 982638 - DNA, 25 bp, Mus musculus
ttttttccgcctgtgaaatgcgtcc

SEQ ID NO: 982639 - DNA, 25 bp, Mus musculus
ttttttccgtcaagcttgaacaatg

SEQ ID NO: 982640 - DNA, 25 bp, Mus musculus
ttttttccgtcatgcttgaacaatg

SEQ ID NO: 982641 - DNA, 25 bp, Mus musculus
ttttttcctataagatagggccagt

SEQ ID NO: 982642 - DNA, 25 bp, Mus musculus
ttttttcctatatgatagggccagt

SEQ ID NO: 982643 - DNA, 25 bp, Mus musculus
ttttttcctatcaaagcctaaagat

SEQ ID NO: 982644 - DNA, 25 bp, Mus musculus
ttttttcctatcctcaaatcttcaa

SEQ ID NO: 982645 - DNA, 25 bp, Mus musculus
ttttttcctatcgtcaaatcttcaa

SEQ ID NO: 982646 - DNA, 25 bp, Mus musculus
ttttttcctatctaagcctaaagat

SEQ ID NO: 982647 - DNA, 25 bp, Mus musculus
ttttttcctccaatgataatctcaa

SEQ ID NO: 982648 - DNA, 25 bp, Mus musculus
ttttttcctccattgataatctcaa

SEQ ID NO: 982649 - DNA, 25 bp, Mus musculus
ttttttcctctcatgcttgggcaaa

SEQ ID NO: 982650 - DNA, 25 bp, Mus musculus
ttttttcctctcttgcttgggcaaa

SEQ ID NO: 982651 - DNA, 25 bp, Mus musculus
ttttttcctcttaggtagacttatg

SEQ ID NO: 982652 - DNA, 25 bp, Mus musculus
ttttttcctctttggtagacttatg

SEQ ID NO: 982653 - DNA, 25 bp, Mus musculus
ttttttcctgctctgatactgcatt

SEQ ID NO: 982654 - DNA, 25 bp, Mus musculus
ttttttcctgctgtgatactgcatt

SEQ ID NO: 982655 - DNA, 25 bp, Mus musculus
ttttttcctggcaatactttattca

SEQ ID NO: 982656 - DNA, 25 bp, Mus musculus
ttttttcctggctatactttattca

SEQ ID NO: 982657 - DNA, 25 bp, Mus musculus
ttttttcctgtgctgagatagaacc

SEQ ID NO: 982658 - DNA, 25 bp, Mus musculus
ttttttcctgtggtgagatagaacc

SEQ ID NO: 982659 - DNA, 25 bp, Mus musculus
ttttttccttcacatgctatccata

SEQ ID NO: 982660 - DNA, 25 bp, Mus musculus
ttttttccttcagatgctatccata

SEQ ID NO: 982661 - DNA, 25 bp, Mus musculus
ttttttccttccacacagtggtcat

SEQ ID NO: 982662 - DNA, 25 bp, Mus musculus
ttttttccttcctcacagtggtcat

SEQ ID NO: 982663 - DNA, 25 bp, Mus musculus
ttttttccttcgcaggcatcagctg

SEQ ID NO: 982664 - DNA, 25 bp, Mus musculus
ttttttccttcggaggcatcagctg

SEQ ID NO: 982665 - DNA, 25 bp, Mus musculus
ttttttccttctagtatgtcagttt

SEQ ID NO: 982666 - DNA, 25 bp, Mus musculus
ttttttccttctcgctctggctctg

SEQ ID NO: 982667 - DNA, 25 bp, Mus musculus
ttttttccttctggctctggctctg

SEQ ID NO: 982668 - DNA, 25 bp, Mus musculus
ttttttccttcttgtatgtcagttt

SEQ ID NO: 982669 - DNA, 25 bp, Mus musculus
ttttttccttgtcagatgtattgta

SEQ ID NO: 982670 - DNA, 25 bp, Mus musculus
ttttttccttgtgagatgtattgta

SEQ ID NO: 982671 - DNA, 25 bp, Mus musculus
ttttttcctttgagccaggcaggaa

SEQ ID NO: 982672 - DNA, 25 bp, Mus musculus
ttttttcctttgtgccaggcaggaa

SEQ ID NO: 982673 - DNA, 25 bp, Mus musculus
ttttttccttttcccagactaggag

SEQ ID NO: 982674 - DNA, 25 bp, Mus musculus
ttttttccttttgccagactaggag

SEQ ID NO: 982675 - DNA, 25 bp, Mus musculus
ttttttcgggacacggatgccaagt

SEQ ID NO: 982676 - DNA, 25 bp, Mus musculus
ttttttcgggactcggatgccaagt

SEQ ID NO: 982677 - DNA, 25 bp, Mus musculus
ttttttcggtttctcagcagattat

SEQ ID NO: 982678 - DNA, 25 bp, Mus musculus
ttttttcggtttgtcagcagattat

SEQ ID NO: 982679 - DNA, 25 bp, Mus musculus
ttttttcgtatcacaaagtcatggg

SEQ ID NO: 982680 - DNA, 25 bp, Mus musculus
ttttttcgtatctcaaagtcatggg

SEQ ID NO: 982681 - DNA, 25 bp, Mus musculus
ttttttcgtgctccccattgtacac

SEQ ID NO: 982682 - DNA, 25 bp, Mus musculus
ttttttcgtgctgcccattgtacac

SEQ ID NO: 982683 - DNA, 25 bp, Mus musculus
ttttttcgttcacctttcttcatgc

SEQ ID NO: 982684 - DNA, 25 bp, Mus musculus
ttttttcgttcagctttcttcatgc

SEQ ID NO: 982685 - DNA, 25 bp, Mus musculus
ttttttctaaacatgcccatctggg

SEQ ID NO: 982686 - DNA, 25 bp, Mus musculus
ttttttctaaacttgcccatctggg

SEQ ID NO: 982687 - DNA, 25 bp, Mus musculus
ttttttctaacaacacccacagagg

SEQ ID NO: 982688 - DNA, 25 bp, Mus musculus
ttttttctaacaacgtgccccttgt

SEQ ID NO: 982689 - DNA, 25 bp, Mus musculus
ttttttctaacatcacccacagagg

SEQ ID NO: 982690 - DNA, 25 bp, Mus musculus
ttttttctaacatcgtgccccttgt

SEQ ID NO: 982691 - DNA, 25 bp, Mus musculus
ttttttctaataaagcgctgcacac

SEQ ID NO: 982692 - DNA, 25 bp, Mus musculus
ttttttctaatatagcgctgcacac

SEQ ID NO: 982693 - DNA, 25 bp, Mus musculus
ttttttctaatccagtccaggttgg

SEQ ID NO: 982694 - DNA, 25 bp, Mus musculus
ttttttctaatcgagtccaggttgg

SEQ ID NO: 982695 - DNA, 25 bp, Mus musculus
ttttttctacatacatcccatccat

SEQ ID NO: 982696 - DNA, 25 bp, Mus musculus
ttttttctacattcatcccatccat

SEQ ID NO: 982697 - DNA, 25 bp, Mus musculus
ttttttctacctaggatagctccca

SEQ ID NO: 982698 - DNA, 25 bp, Mus musculus
ttttttctaccttggatagctccca

SEQ ID NO: 982699 - DNA, 25 bp, Mus musculus
ttttttctacggatatttcatttat

SEQ ID NO: 982700 - DNA, 25 bp, Mus musculus
ttttttctacggttatttcatttat

SEQ ID NO: 982701 - DNA, 25 bp, Mus musculus
ttttttctactcatctataactttt

SEQ ID NO: 982702 - DNA, 25 bp, Mus musculus
ttttttctactcttctataactttt

SEQ ID NO: 982703 - DNA, 25 bp, Mus musculus
ttttttctactgatctacccaagtg

SEQ ID NO: 982704 - DNA, 25 bp, Mus musculus
ttttttctactgttctacccaagtg

SEQ ID NO: 982705 - DNA, 25 bp, Mus musculus
ttttttctatcaatgactccctccc

SEQ ID NO: 982706 - DNA, 25 bp, Mus musculus
ttttttctatcattgactccctccc

SEQ ID NO: 982707 - DNA, 25 bp, Mus musculus
ttttttctatgtcaggttcaaaagt

SEQ ID NO: 982708 - DNA, 25 bp, Mus musculus
ttttttctatgtgaggttcaaaagt

SEQ ID NO: 982709 - DNA, 25 bp, Mus musculus
ttttttctcagcctccggaaagagc

SEQ ID NO: 982710 - DNA, 25 bp, Mus musculus
ttttttctcagcgtccggaaagagc

SEQ ID NO: 982711 - DNA, 25 bp, Mus musculus
ttttttctccaccagtcttaaatgg

SEQ ID NO: 982712 - DNA, 25 bp, Mus musculus
ttttttctccacgagtcttaaatgg

SEQ ID NO: 982713 - DNA, 25 bp, Mus musculus
ttttttctccagaatactgtgatta

SEQ ID NO: 982714 - DNA, 25 bp, Mus musculus
ttttttctccagtatactgtgatta

SEQ ID NO: 982715 - DNA, 25 bp, Mus musculus
ttttttctccatccattaaagatcc

SEQ ID NO: 982716 - DNA, 25 bp, Mus musculus
ttttttctccatctgtcaccaagtg

SEQ ID NO: 982717 - DNA, 25 bp, Mus musculus
ttttttctccatgcattaaagatcc

SEQ ID NO: 982718 - DNA, 25 bp, Mus musculus
ttttttctccatgtgtcaccaagtg

SEQ ID NO: 982719 - DNA, 25 bp, Mus musculus
ttttttctcccaaacagttgtcatt

SEQ ID NO: 982720 - DNA, 25 bp, Mus musculus
ttttttctcccatacagttgtcatt

SEQ ID NO: 982721 - DNA, 25 bp, Mus musculus
ttttttctccccaagcagctgaatt

SEQ ID NO: 982722 - DNA, 25 bp, Mus musculus
ttttttctcccctagcagctgaatt

SEQ ID NO: 982723 - DNA, 25 bp, Mus musculus
ttttttctcgttccaattttaagtg

SEQ ID NO: 982724 - DNA, 25 bp, Mus musculus
ttttttctcgttgcaattttaagtg

SEQ ID NO: 982725 - DNA, 25 bp, Mus musculus
ttttttctctatagctacccacatt

SEQ ID NO: 982726 - DNA, 25 bp, Mus musculus
ttttttctctatatgagtggctgac

SEQ ID NO: 982727 - DNA, 25 bp, Mus musculus
ttttttctctattgctacccacatt

SEQ ID NO: 982728 - DNA, 25 bp, Mus musculus
ttttttctctatttgagtggctgac

SEQ ID NO: 982729 - DNA, 25 bp, Mus musculus
ttttttctctctaaggatcactcat

SEQ ID NO: 982730 - DNA, 25 bp, Mus musculus
ttttttctctcttaggatcactcat

SEQ ID NO: 982731 - DNA, 25 bp, Mus musculus
ttttttctctgcattctgactatga

SEQ ID NO: 982732 - DNA, 25 bp, Mus musculus
ttttttctctgctttctgactatga

SEQ ID NO: 982733 - DNA, 25 bp, Mus musculus
ttttttctcttgcgaagtcacctgt

SEQ ID NO: 982734 - DNA, 25 bp, Mus musculus
ttttttctcttgggaagtcacctgt

SEQ ID NO: 982735 - DNA, 25 bp, Mus musculus
ttttttctgactctaatctttgata

SEQ ID NO: 982736 - DNA, 25 bp, Mus musculus
ttttttctgactgtaatctttgata

SEQ ID NO: 982737 - DNA, 25 bp, Mus musculus
ttttttctgagcaagcctttagaac

SEQ ID NO: 982738 - DNA, 25 bp, Mus musculus
ttttttctgagctagcctttagaac

SEQ ID NO: 982739 - DNA, 25 bp, Mus musculus
ttttttctgcacagctttccaaaat

SEQ ID NO: 982740 - DNA, 25 bp, Mus musculus
ttttttctgcaccactatgtgctaa

SEQ ID NO: 982741 - DNA, 25 bp, Mus musculus
ttttttctgcacgactatgtgctaa

SEQ ID NO: 982742 - DNA, 25 bp, Mus musculus
ttttttctgcactgctttccaaaat

SEQ ID NO: 982743 - DNA, 25 bp, Mus musculus
ttttttctgccacacctaagaggac

SEQ ID NO: 982744 - DNA, 25 bp, Mus musculus
ttttttctgccagacctaagaggac

SEQ ID NO: 982745 - DNA, 25 bp, Mus musculus
ttttttctgcgtagagaggatgatc

SEQ ID NO: 982746 - DNA, 25 bp, Mus musculus
ttttttctgcgttgagaggatgatc

SEQ ID NO: 982747 - DNA, 25 bp, Mus musculus
ttttttctgctgaaggtcaaggatg

SEQ ID NO: 982748 - DNA, 25 bp, Mus musculus
ttttttctgctgtaggtcaaggatg

SEQ ID NO: 982749 - DNA, 25 bp, Mus musculus
ttttttctgtaccacaactttatag

SEQ ID NO: 982750 - DNA, 25 bp, Mus musculus
ttttttctgtacgacaactttatag

SEQ ID NO: 982751 - DNA, 25 bp, Mus musculus
ttttttctgtgaaatcttggaggac

SEQ ID NO: 982752 - DNA, 25 bp, Mus musculus
ttttttctgtgatatcttggaggac

SEQ ID NO: 982753 - DNA, 25 bp, Mus musculus
ttttttctgtgcagtaactcactct

SEQ ID NO: 982754 - DNA, 25 bp, Mus musculus
ttttttctgtgcagttgagcatcaa

SEQ ID NO: 982755 - DNA, 25 bp, Mus musculus
ttttttctgtgctgtaactcactct

SEQ ID NO: 982756 - DNA, 25 bp, Mus musculus
ttttttctgtgctgttgagcatcaa

SEQ ID NO: 982757 - DNA, 25 bp, Mus musculus
ttttttctgttcagtcctcttggtg

SEQ ID NO: 982758 - DNA, 25 bp, Mus musculus
ttttttctgttctgtcctcttggtg

SEQ ID NO: 982759 - DNA, 25 bp, Mus musculus
ttttttcttgccattgaatcaaaaa

SEQ ID NO: 982760 - DNA, 25 bp, Mus musculus
ttttttcttgcctttgaatcaaaaa

SEQ ID NO: 982761 - DNA, 25 bp, Mus musculus
ttttttcttgctataggctaataat

SEQ ID NO: 982762 - DNA, 25 bp, Mus musculus
ttttttcttgctttaggctaataat

SEQ ID NO: 982763 - DNA, 25 bp, Mus musculus
ttttttcttggtcatctccagcttc

SEQ ID NO: 982764 - DNA, 25 bp, Mus musculus
ttttttcttggtgatctccagcttc

SEQ ID NO: 982765 - DNA, 25 bp, Mus musculus
ttttttcttgtcatgattccctaca

SEQ ID NO: 982766 - DNA, 25 bp, Mus musculus
ttttttcttgtcttgattccctaca

SEQ ID NO: 982767 - DNA, 25 bp, Mus musculus
ttttttctttaaacatcccatcaca

SEQ ID NO: 982768 - DNA, 25 bp, Mus musculus
ttttttctttaatcatcccatcaca

SEQ ID NO: 982769 - DNA, 25 bp, Mus musculus
ttttttctttatctcattctgcttt

SEQ ID NO: 982770 - DNA, 25 bp, Mus musculus
ttttttctttatgtcattctgcttt

SEQ ID NO: 982771 - DNA, 25 bp, Mus musculus
ttttttctttgcatcactacaaact

SEQ ID NO: 982772 - DNA, 25 bp, Mus musculus
ttttttctttgcttcactacaaact

SEQ ID NO: 982773 - DNA, 25 bp, Mus musculus
ttttttgaacaaatggcacaattga

SEQ ID NO: 982774 - DNA, 25 bp, Mus musculus
ttttttgaacaattggcacaattga

SEQ ID NO: 982775 - DNA, 25 bp, Mus musculus
ttttttgaacccaccttctacatat

SEQ ID NO: 982776 - DNA, 25 bp, Mus musculus
ttttttgaaccctccttctacatat

SEQ ID NO: 982777 - DNA, 25 bp, Mus musculus
ttttttgaacctacagaccccatgc

SEQ ID NO: 982778 - DNA, 25 bp, Mus musculus
ttttttgaaccttcagaccccatgc

SEQ ID NO: 982779 - DNA, 25 bp, Mus musculus
ttttttgaacttcttcttgacaaga

SEQ ID NO: 982780 - DNA, 25 bp, Mus musculus
ttttttgaacttgttcttgacaaga

SEQ ID NO: 982781 - DNA, 25 bp, Mus musculus
ttttttgaagaactgccggaggcca

SEQ ID NO: 982782 - DNA, 25 bp, Mus musculus
ttttttgaagaagtgccggaggcca

SEQ ID NO: 982783 - DNA, 25 bp, Mus musculus
ttttttgaagctccgtaatgcacgt

SEQ ID NO: 982784 - DNA, 25 bp, Mus musculus
ttttttgaagctgcgtaatgcacgt

SEQ ID NO: 982785 - DNA, 25 bp, Mus musculus
ttttttgacaaaccgtgtactgtgt

SEQ ID NO: 982786 - DNA, 25 bp, Mus musculus
ttttttgacaaagcgtgtactgtgt

SEQ ID NO: 982787 - DNA, 25 bp, Mus musculus
ttttttgacatccatacatgtgctg

SEQ ID NO: 982788 - DNA, 25 bp, Mus musculus
ttttttgacatcgatacatgtgctg

SEQ ID NO: 982789 - DNA, 25 bp, Mus musculus
ttttttgaccttcacgtagacgcgt

SEQ ID NO: 982790 - DNA, 25 bp, Mus musculus
ttttttgaccttgacgtagacgcgt

SEQ ID NO: 982791 - DNA, 25 bp, Mus musculus
ttttttgacggaaccatttccctat

SEQ ID NO: 982792 - DNA, 25 bp, Mus musculus
ttttttgacggatccatttccctat

SEQ ID NO: 982793 - DNA, 25 bp, Mus musculus
ttttttgagctgcaccgatctctgg

SEQ ID NO: 982794 - DNA, 25 bp, Mus musculus
ttttttgagctggaccgatctctgg

SEQ ID NO: 982795 - DNA, 25 bp, Mus musculus
ttttttgattttagcgagaccaggg

SEQ ID NO: 982796 - DNA, 25 bp, Mus musculus
ttttttgatttttgcgagaccaggg

SEQ ID NO: 982797 - DNA, 25 bp, Mus musculus
ttttttgcaaatcggcgtgaggcct

SEQ ID NO: 982798 - DNA, 25 bp, Mus musculus
ttttttgcaaatgggcgtgaggcct

SEQ ID NO: 982799 - DNA, 25 bp, Mus musculus
ttttttgcaactaggatttccagtt

SEQ ID NO: 982800 - DNA, 25 bp, Mus musculus
ttttttgcaacttggatttccagtt

SEQ ID NO: 982801 - DNA, 25 bp, Mus musculus
ttttttgcaagcctcctattctcaa

SEQ ID NO: 982802 - DNA, 25 bp, Mus musculus
ttttttgcaagcgtcctattctcaa

SEQ ID NO: 982803 - DNA, 25 bp, Mus musculus
ttttttgcaaggatcattccaggga

SEQ ID NO: 982804 - DNA, 25 bp, Mus musculus
ttttttgcaaggttcattccaggga

SEQ ID NO: 982805 - DNA, 25 bp, Mus musculus
ttttttgcaatccttccactcgctg

SEQ ID NO: 982806 - DNA, 25 bp, Mus musculus
ttttttgcaatcgttccactcgctg

SEQ ID NO: 982807 - DNA, 25 bp, Mus musculus
ttttttgcatgaacttcctgttgaa

SEQ ID NO: 982808 - DNA, 25 bp, Mus musculus
ttttttgcatgatcttcctgttgaa

SEQ ID NO: 982809 - DNA, 25 bp, Mus musculus
ttttttgccattcctacaagcccag

SEQ ID NO: 982810 - DNA, 25 bp, Mus musculus
ttttttgccattgctacaagcccag

SEQ ID NO: 982811 - DNA, 25 bp, Mus musculus
ttttttgcccttactgtctttcagg

SEQ ID NO: 982812 - DNA, 25 bp, Mus musculus
ttttttgcccttattgccctgatgg

SEQ ID NO: 982813 - DNA, 25 bp, Mus musculus
ttttttgccctttctgtctttcagg

SEQ ID NO: 982814 - DNA, 25 bp, Mus musculus
ttttttgccctttttgccctgatgg

SEQ ID NO: 982815 - DNA, 25 bp, Mus musculus
ttttttgccgcaatgacccgtgtct

SEQ ID NO: 982816 - DNA, 25 bp, Mus musculus
ttttttgccgcattgacccgtgtct

SEQ ID NO: 982817 - DNA, 25 bp, Mus musculus
ttttttgctctaactgggttattta

SEQ ID NO: 982818 - DNA, 25 bp, Mus musculus
ttttttgctctaattctctctaaca

SEQ ID NO: 982819 - DNA, 25 bp, Mus musculus
ttttttgctctatctgggttattta

SEQ ID NO: 982820 - DNA, 25 bp, Mus musculus
ttttttgctctatttctctctaaca

SEQ ID NO: 982821 - DNA, 25 bp, Mus musculus
ttttttgctgagcttccctgggtca

SEQ ID NO: 982822 - DNA, 25 bp, Mus musculus
ttttttgctgaggttccctgggtca

SEQ ID NO: 982823 - DNA, 25 bp, Mus musculus
ttttttgctgctcattctatctgtt

SEQ ID NO: 982824 - DNA, 25 bp, Mus musculus
ttttttgctgctgattctatctgtt

SEQ ID NO: 982825 - DNA, 25 bp, Mus musculus
ttttttgctgtcaggccattgtgtc

SEQ ID NO: 982826 - DNA, 25 bp, Mus musculus
ttttttgctgtctggccattgtgtc

SEQ ID NO: 982827 - DNA, 25 bp, Mus musculus
ttttttgcttacaagcaacccgatg

SEQ ID NO: 982828 - DNA, 25 bp, Mus musculus
ttttttgcttactagcaacccgatg

SEQ ID NO: 982829 - DNA, 25 bp, Mus musculus
ttttttgcttgtccggctgcctctt

SEQ ID NO: 982830 - DNA, 25 bp, Mus musculus
ttttttgcttgtgcggctgcctctt

SEQ ID NO: 982831 - DNA, 25 bp, Mus musculus
ttttttggaaagctgcctcaagcag

SEQ ID NO: 982832 - DNA, 25 bp, Mus musculus
ttttttggaaaggtgcctcaagcag

SEQ ID NO: 982833 - DNA, 25 bp, Mus musculus
ttttttggatacagctgcccaagga

SEQ ID NO: 982834 - DNA, 25 bp, Mus musculus
ttttttggatactgctgcccaagga

SEQ ID NO: 982835 - DNA, 25 bp, Mus musculus
ttttttggcactacgcagttgtgta

SEQ ID NO: 982836 - DNA, 25 bp, Mus musculus
ttttttggcacttcgcagttgtgta

SEQ ID NO: 982837 - DNA, 25 bp, Mus musculus
ttttttggcatgatcatcaatgaac

SEQ ID NO: 982838 - DNA, 25 bp, Mus musculus
ttttttggcatgttcatcaatgaac

SEQ ID NO: 982839 - DNA, 25 bp, Mus musculus
ttttttggcttcactcgtgatcacc

SEQ ID NO: 982840 - DNA, 25 bp, Mus musculus
ttttttggcttctctcgtgatcacc

SEQ ID NO: 982841 - DNA, 25 bp, Mus musculus
ttttttgggcctacatagggtccat

SEQ ID NO: 982842 - DNA, 25 bp, Mus musculus
ttttttgggccttcatagggtccat

SEQ ID NO: 982843 - DNA, 25 bp, Mus musculus
ttttttgggtcaagtgccattgaag

SEQ ID NO: 982844 - DNA, 25 bp, Mus musculus
ttttttgggtcatgtgccattgaag

SEQ ID NO: 982845 - DNA, 25 bp, Mus musculus
ttttttggtataacactggcttttt

SEQ ID NO: 982846 - DNA, 25 bp, Mus musculus
ttttttggtatatcactggcttttt

SEQ ID NO: 982847 - DNA, 25 bp, Mus musculus
ttttttggtatgactgtagcagctg

SEQ ID NO: 982848 - DNA, 25 bp, Mus musculus
ttttttggtatgtctgtagcagctg

SEQ ID NO: 982849 - DNA, 25 bp, Mus musculus
ttttttggtcatcaaattcctgcca

SEQ ID NO: 982850 - DNA, 25 bp, Mus musculus
ttttttggtcatgaaattcctgcca

SEQ ID NO: 982851 - DNA, 25 bp, Mus musculus
ttttttgtaacccagagtgagaaag

SEQ ID NO: 982852 - DNA, 25 bp, Mus musculus
ttttttgtaaccgagagtgagaaag

SEQ ID NO: 982853 - DNA, 25 bp, Mus musculus
ttttttgtaactctggtgtagctct

SEQ ID NO: 982854 - DNA, 25 bp, Mus musculus
ttttttgtaactgtggtgtagctct

SEQ ID NO: 982855 - DNA, 25 bp, Mus musculus
ttttttgtacaacacagccggctgg

SEQ ID NO: 982856 - DNA, 25 bp, Mus musculus
ttttttgtacaagacagccggctgg

SEQ ID NO: 982857 - DNA, 25 bp, Mus musculus
ttttttgtacgacaacatgaagaaa

SEQ ID NO: 982858 - DNA, 25 bp, Mus musculus
ttttttgtacgagaacatgaagaaa

SEQ ID NO: 982859 - DNA, 25 bp, Mus musculus
ttttttgtacggacctagtcagtag

SEQ ID NO: 982860 - DNA, 25 bp, Mus musculus
ttttttgtacggtcctagtcagtag

SEQ ID NO: 982861 - DNA, 25 bp, Mus musculus
ttttttgtagctatattctgccttg

SEQ ID NO: 982862 - DNA, 25 bp, Mus musculus
ttttttgtagctttattctgccttg

SEQ ID NO: 982863 - DNA, 25 bp, Mus musculus
ttttttgtagggattggagatgtgt

SEQ ID NO: 982864 - DNA, 25 bp, Mus musculus
ttttttgtagggtttggagatgtgt

SEQ ID NO: 982865 - DNA, 25 bp, Mus musculus
ttttttgtagttcctgtctgttcat

SEQ ID NO: 982866 - DNA, 25 bp, Mus musculus
ttttttgtagttgctgtctgttcat

SEQ ID NO: 982867 - DNA, 25 bp, Mus musculus
ttttttgtatttcaattcgttgtat

SEQ ID NO: 982868 - DNA, 25 bp, Mus musculus
ttttttgtatttgaattcgttgtat

SEQ ID NO: 982869 - DNA, 25 bp, Mus musculus
ttttttgtcacaagccagggatatc

SEQ ID NO: 982870 - DNA, 25 bp, Mus musculus
ttttttgtcacactactcgggaatc

SEQ ID NO: 982871 - DNA, 25 bp, Mus musculus
ttttttgtcacagtactcgggaatc

SEQ ID NO: 982872 - DNA, 25 bp, Mus musculus
ttttttgtcacatgccagggatatc

SEQ ID NO: 982873 - DNA, 25 bp, Mus musculus
ttttttgtcatcacccaggcaacta

SEQ ID NO: 982874 - DNA, 25 bp, Mus musculus
ttttttgtcatctcccaggcaacta

SEQ ID NO: 982875 - DNA, 25 bp, Mus musculus
ttttttgtccctctcgaacatgtat

SEQ ID NO: 982876 - DNA, 25 bp, Mus musculus
ttttttgtccctgtcgaacatgtat

SEQ ID NO: 982877 - DNA, 25 bp, Mus musculus
ttttttgtcctgctcagtccaaagg

SEQ ID NO: 982878 - DNA, 25 bp, Mus musculus
ttttttgtcctggtcagtccaaagg

SEQ ID NO: 982879 - DNA, 25 bp, Mus musculus
ttttttgtcttacaagtagggcaat

SEQ ID NO: 982880 - DNA, 25 bp, Mus musculus
ttttttgtcttagaagtagggcaat

SEQ ID NO: 982881 - DNA, 25 bp, Mus musculus
ttttttgtcttcacactatgtgtaa

SEQ ID NO: 982882 - DNA, 25 bp, Mus musculus
ttttttgtcttctcactatgtgtaa

SEQ ID NO: 982883 - DNA, 25 bp, Mus musculus
ttttttgtgactaccctgaattcac

SEQ ID NO: 982884 - DNA, 25 bp, Mus musculus
ttttttgtgacttccctgaattcac

SEQ ID NO: 982885 - DNA, 25 bp, Mus musculus
ttttttgtgcccacttgaatccaag

SEQ ID NO: 982886 - DNA, 25 bp, Mus musculus
ttttttgtgccctcttgaatccaag

SEQ ID NO: 982887 - DNA, 25 bp, Mus musculus
ttttttgtgcctatttctttttatg

SEQ ID NO: 982888 - DNA, 25 bp, Mus musculus
ttttttgtgcctttttctttttatg

SEQ ID NO: 982889 - DNA, 25 bp, Mus musculus
ttttttgtgcgactaatccttaaat

SEQ ID NO: 982890 - DNA, 25 bp, Mus musculus
ttttttgtgcgagtaatccttaaat

SEQ ID NO: 982891 - DNA, 25 bp, Mus musculus
ttttttgtggacacacttgccccct

SEQ ID NO: 982892 - DNA, 25 bp, Mus musculus
ttttttgtggactcacttgccccct

SEQ ID NO: 982893 - DNA, 25 bp, Mus musculus
ttttttgtgggtactgggcaatgaa

SEQ ID NO: 982894 - DNA, 25 bp, Mus musculus
ttttttgtgggttctgggcaatgaa

SEQ ID NO: 982895 - DNA, 25 bp, Mus musculus
ttttttgtgtagcagccagctggcc

SEQ ID NO: 982896 - DNA, 25 bp, Mus musculus
ttttttgtgtaggagccagctggcc

SEQ ID NO: 982897 - DNA, 25 bp, Mus musculus
ttttttgtgtgcattgcccgactaa

SEQ ID NO: 982898 - DNA, 25 bp, Mus musculus
ttttttgtgtgctttgcccgactaa

SEQ ID NO: 982899 - DNA, 25 bp, Mus musculus
ttttttgtgtggacgcccctgaagt

SEQ ID NO: 982900 - DNA, 25 bp, Mus musculus
ttttttgtgtggtcgcccctgaagt

SEQ ID NO: 982901 - DNA, 25 bp, Mus musculus
ttttttgtgttgaggtgatgtagat

SEQ ID NO: 982902 - DNA, 25 bp, Mus musculus
ttttttgtgttgtggtgatgtagat

SEQ ID NO: 982903 - DNA, 25 bp, Mus musculus
ttttttgttaacatgcctgttgccg

SEQ ID NO: 982904 - DNA, 25 bp, Mus musculus
ttttttgttaacttgcctgttgccg

SEQ ID NO: 982905 - DNA, 25 bp, Mus musculus
ttttttgttctcatgctagctgtgt

SEQ ID NO: 982906 - DNA, 25 bp, Mus musculus
ttttttgttctcttgctagctgtgt

SEQ ID NO: 982907 - DNA, 25 bp, Mus musculus
ttttttgtttaaagtcaacttcagt

SEQ ID NO: 982908 - DNA, 25 bp, Mus musculus
ttttttgtttaatgtcaacttcagt

SEQ ID NO: 982909 - DNA, 25 bp, Mus musculus
tttttttagagcaatgagtcagggc

SEQ ID NO: 982910 - DNA, 25 bp, Mus musculus
tttttttagagctatgagtcagggc

SEQ ID NO: 982911 - DNA, 25 bp, Mus musculus
tttttttcatttctaaccatgccta

SEQ ID NO: 982912 - DNA, 25 bp, Mus musculus
tttttttcatttgtaaccatgccta

SEQ ID NO: 982913 - DNA, 25 bp, Mus musculus
tttttttttgagctgcagggcatga

SEQ ID NO: 982914 - DNA, 25 bp, Mus musculus
tttttttttgaggtgcagggcatga
